United States Patent 10,724,096 (METHODS AND COMPOSITIONS FOR INHIBITING AND TREATING NEUROLOGICAL CONDITIONS) - sequence listing, part 76

SEQ ID NO: 1530 - DNA, 1068176 bp, Homo sapiens
atttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttaggatgtgaagaggaaggtttgatttgagggagatttaaagtactttagccgagtactataccatctactctgtacttataccatctactctgttaatggtataaggccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatcttttttttttttttttttttttttgagacagaatgttgctctgtcacctaggctggagtgcaatggcgcaatctcagctcactacaggctctgcctcctgggttcatgccattttcctgcctcagcctcccgagtagccgggactacaggcgcccgccaccacgcccggctaattttttgtgtttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggtagcgttcgtcacgcctctgcgtagaatcccccagtgacttcccatgtcactcagagtaaaggccataggcttataaggtgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactgtatgttttacttattttgttttgtgtccctcctcccccaactggaatgtaaattctaggaaggcaaagatttttgcttagttttgtttactactctctctctccaggacctgtggtattgcctggcatagaaggatactcagtgaacatttgttgagtgaatgccattttccatctgagtgagatactgtttttaagagtttgtgtctatttcagcacatgaaggaattgctgtctgcaatttccttgagaaaaatcttatgggaaaatagggacaattttcttttcttttctttccttttttaagacggggttttgctctgtcgtctaggctggaatgcagtggcgttatcctggctcattacaacctctgcctcctaagttgaagcgattcttgtgcctcagcctcctgagtagctgggattacaggcatgcacctccacgcctggctaatttctgtatttttagtagagacggggttttgccatgtgggctatgctggtttcaaactcctgagctcaagtgatcctcccaccttggcctcccaaagtgctaggattacaggtgtgaaccatggctcctggccttcttttctaattttaaacaattgtatccaagtgacattatcctcaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttttgagacggagtatcgttcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaagtgaccttcctgaccttggtgtcccaaagtgctgggattacaggcatgagccactgcacctggcctccatggtgttattcttaagtggtccaaatatgtttttttaaattgtggtgtaatttacaaaaatgaaatacatcttgagtttacagtttgatcagttttaatatatgcacactcatgtaacctacactcctatatagacacagaatatttttataactccataaaatttccttgtgcggttttttttttttgagacggagtctcgccttatcgcctaggctggagtgcagtggcacgatgttggctcaccacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatattgttacagatacccgtagtttgtgcttttttattgctgagtagtatgaatataccatagtttgtttatccatccttcttctgctggtagatatctaggctatttccattttttttttttaagtcatgaataaagcaagctactgccaaaattcactggcaagtctttgtggatatatattttctttttttgggggagggggacagagtcttgctgtgtcatccaggctggagtgcagtggcacgatctcggctcactgcaacctctgactcccaagttcaggcagttctcatgcctcagcctccccagtagctagaattacaggtatgcgccaccatgcctggctaatttttgtatttttagtagagactggattttgccatgttggccagcctggtctcaaactcctggcctcaataatccgcccatgttgacctcccaaagtgctgagattacaggtgtgagccaccatgcccggcccgtggacatacattttcatttcttttttaagagacggggtgtcactttttgcctacgccggactgcagtgatgctatcgtagttggctgtaatctcgaactcataggctcaagccatcctcctacctcagcctccaagtggctaggactaccggtatgctccatcatgcctggctaatttttaaatttttttggcagagacaaggtcttactataatatgttgcccaggctggtctcaaactcctgggctcaagcagtcctcctgcccctatctcccaaagtgctgcgattacaggcatgaattttaatttcttttaatttaatttaatttcttttaaattaaaattcacatctgtaattttaatttcttttaatttaatttcttttaaatgaaaattcacgcctgtaatcacagcactttgaggggtaggggcaggaggactgcttcagcccaggagaccagcctgggcaacatattatatagtaagaccagttgtctaccaaaaaaatttgaaaattagccaggcatgatggcgcataacctgtagtcctagctacttggaggctgaggttggaggatgttaaacactctttcatgtgctcattagctgcttatgtatctttttgtgaagtttctgttcaaatctttatcaacttgtaaattagattttaaaaaatttgtaagctggtgaagttcttacatgttctagacatgagttcttgaccatattttcccttagaatgtggctttaacagtgtctttgatgagcagaattttttattttagttatccaatgtatcagttttttattttattttattttatttttgagatggagtcttgctctgttgcccaggctgtagtgcagtggcatgatctcagctcactgcaagctccacctcccaggttcacaccattctcctgcctcagcctcccgagtagctgggattacaggcacccgccaccacacctggctaattttttgtatttttagtagagaccacgtttcaccatgttggacaggctggtcttgaactcctaacctcaagtgatccaccagccttggcctcccaaagttttgggattacaggcatgagccactgtgcccagccaaggatattctttttataacattttcaaaaattaaggcatattgtatatacaggaaaaaaaatgaagcctatgatttatatttacaattgctttgatttaatacaaattaaaatattactgtttatgagaatgagattctaaatgtaaatggaattcacagaatgcataatttttttctcgtttaaagaaatagagtctcgctgtatgcctaggctggtctcgaactcctgggctccagccatcctcccatttcagcctcccagagtgttgggattacaggcgtgagccaccacgcctggccttgtacatgttatatagtgaccattttgcacaagattgtttgccaaatgaataattaaaaaaatccatttagtgtactttcctttaaatattttcacacctggagttaaaacattgtattttataaaatgttattaatataaaaatacttgtaaataaacttgtggctatgtagaatgtagtagaggacttttgcataagcccagagcctagtttctaaaggtctttagaaatatataatagacatagaggggaaagagttgggggaaatcagagggaggtataattctggtctctcgtcgttcagttctttttcattcagttctctcaggcacgactccagccacttagttttatatttcaactggatgttgacccaattaaaacaattcacagctcctgaagatgaaatactatgagtccctgctttggacacatctgtagtagagtaggaaaagataaatataacccaagtaattgttacagaatcttctgaaatatacaaatggtaaaaggttttgtagggcgtgtactggggaaaaagataatttttcaacatgaaccttttaagagcttgtgagtctcaaagagtctttaattgataggtgatatggataatactcccctttgggaggaggtttataatacataaacaacctccccacccttccctcacagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagtattacaaggttcagtgaattgtctgagatctcacaaatacaacctagataagaacccaggtattattattttcagtcttgcaatattattttcctacttgcaatattatcttcactcttcattaagtttgcacagcaaagtaatggaataagttctgggctttaatccttgagtagtttggaactgtaatgtgttacatttgagagagagcccttcattttgaataaaaccttggtactgttcctgatcttctaacttgggttaatgctcttcccattttcatgatttttttcatttgtgaaatgaagtagttgcactagatcattttcaattttccttcccacttaaatcagttttaattaaaaaaattgcagatgccttttctcagattggagtacactttttgctccacacaatatctggtgtgtaaattggtatgttccgtggagtaaatacctttcctgactagccattaacttacttctgattcctgaatccactaatttaactattgttgaaattactaaaggaaatttttctttagcaaatgtaaaaactcatatcaggtctcaggtttgatgttgtaaagcactctgactcttaggaagactctttttttcccccaacctctcataaacaaattatttcattcattataaaatttcattcattacattttcattcttcagacttgcagtgtttcctctctgctaagtatagtgttaaacactggcaaaagaactctggacacaacatcatgaacttgctctctgggatcttataatctagttgcagaagcagattggtaaatacatagtatagcacaagtactataatggaggcctgaactgagtgctgtgggggtacacagatgaaggcttctgggagacatcatggcataactagacctggaggatgaataaaactttggccaagtaaatacagagatacatgaaaagcatggataaatggcacaagtaggttcagggatgataaaagtgttagtatgtggagagtgtacaactattttggggaatggggaaacagattaaatttggggccagaccccgaaggatgtggggatcccatcaaagtcttttaagcaggagaatgatcagatgcattttttggtatactacctgggggataggaggaagtggactacagaaggggagatcagtagaaggaagacaagttaggaagcttttcagtcattttcattaaacatgaagcttaatacatattgttctaagatcaggaatacagcaataaagaaaaaaacttgctgtaatgaaacttacattttcttgggagagacagaaaataaacatgaaaaacagatgtgttcaatggtgataaagcagaaagggagatggggagtcaagtgcatgtggggagggtgtttagggaagcacttatgaaagagtaacatttgagcaaagagccctgatacaagacaacaatccagacccaagacatttgaggaaagagcatccatataaagggagtgggaggtagagaaaacctggaccaggaatgagcctggtatgattgaggaaaacacaagggatgtggccagagaataataagagaataaattagaggggtaataggcaattgtatagggccttgtgagccattgtgtggaccttggatttcactcttgagtgacctgggagctaatgggggattaaacagaggagggacaggatcctctatggtatatggtaaatgagtagtatggtaaatgaggtaaatgaatagtaaaaggaactgctgtggtaatttaggtaacagatgatgatggtttaggtgaaagtggttggattgtggatatggtttgattggtgttagaaccaataggatttagtggtggctggatgtggacaatgggagaatagaatgaaccaaagctattgtaaacgtctagaaatcagatgaggacttgacgaaaggcattggcaatgagaaagtagacaggcaccattcatgaggtatttcttagcattgatagagttggatataaatatctggaattcttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacgctccacagtcttatcgttcatagtttcttggcaaactcaccactcaagctgtgcctcacttatttaggagatctgcctcactagggtagacattttaggtttatgactcttaagttttcacctggacagattggctaacaaaaagaacctcacaggtgggtgaccttgaattcaccaggtcatgccatcagttcagagcggccggagaactctgttctcttgtgcattgatgcccccggagttgtgaaacacagtggccctgcttcagttttttagatttagaaactggtcagtgtcagagcgatcagacacagaaatgttaattcatgttcaaaaataataaccaggctagcatttgtttagcacttgctatgtgacaagtactgttttaagtgctttacatgaattgtttaatcctcacaacaaccctgggaaataggtcctattattaggcgccctttctacagatgaggaaacagacaacagattggtaaatttcccaagatcacaaagtaagtcagtaggagctcaaagtaacctgactccagagcccacactctttttttttttttttttttttttttttagctggttcacgtctctttaatgagatcaaaggctcctgtgtatgtcttgcgggggtaaagctagcacagtcccccaatactgcccctctcctcagggctccagccctttcaggcagattctaggtaggcagggaggggccaaaaggaacgcaaggagttgggactagggctgtttctggtgggcaagtaacccatccaccctctcaaaactacttatgggatgtccccttcactggaagacagccccatgggaaagacctgcggtacagaatctgggggcagtgcacacggggagtagtcctccagatctggcagggtggcactaaccctcacctccttgactggctcagcctcaccggaggcaggacaagggcagagcttaataccggagtcgccagttaaacggcgatagcggcaggaggggggtgtgggggcaggggtcacccctgccccagactcaccctcctgatgagggagggcactctggtgggaggaaacaccttccacatttgttccttcaaaatgggcagggcagctggatgaggaggaacagcaggtttgttcactggaagcagtcaaggggcggcctggggcgacagtataaggcgcggaggcggggggcggggggtggtgcctgggcggtgaaccacatcctcgtaggctgggggcttgaaggtgctgaggaggcgaaggtcaagcagtgaaccggtagggaaaggaccagccccatggcatgccccatgataagccaacaagttgatttcacgctgccgctgctgttgttgcagcctgagtttagctcgtcggtggcggaaggcccaacagcagctaaagaggatgaggacagtccagagcagccagaaccaccagagctcatagtagtaggtgcagcagccagtctccccgcagcagtgaacactctcacagaggtagggctggttgttcactcctgggcacagctctcgaagctgctgttgcggcgcccgaagtgccccccaggcctcctcgctgccgttcccgctgctggcccgagccatacctccacctacagccccctgaggaccacagcctcctctaccgccagccgccccgcccctgccacctctgctgccactgccatggtccctgcccggcccatcttcgctgaggccaccatcactccgcggccggagcttccatccccagagcccacattcttatctgagcatatacatccccatcacaagagaacgccagtttattcaagtaaaataaggactagaaatttacatcagggaatgtattctttcactgtagaatgctgaatggaaaaccaaatttcaatagttgcctactgaacaagatcatgagataacaacaagggagttgattataaatgactagaagttttaaatggcatcgactctgataaagtgataatctcagctccatgatatactcgtcaagcagttacttacatcaatctgccttataggatatcctttctcctggttaatgcttatgtgatagtgttttgtacctttcctttttcactgctttcattactgaccaaactactcacccccatatttctggtagatatatttcttttcattgcatgttagtatcttaaatttagtcctatcttttacttgatcctccgtgcttgacttcctaatctatgttctggtttatgttttagttttacagttgagctttctgaggacattcttattcccagtatctttttttgggtggttgggttctgggaggtggtatttgactgctgctgatgtgtaccaaccaagacagtagtcattaagtgactaacaataatgatttcagcagattattactcttggcaaagagcaagctttctctattataaatgattttatatttgttttgtttttctttatttgtaatttgagttctagcttaacattattacttcagataactgttaatacattttcataaatcatacattcttgaatggcaaataaataaataatcaagttccaagtagtttctaaagagagtaaacattaaaagtaaacataaaactacataaaaatcgatcacagtctattcataaagttggtatgaaaataaagatcctagatttggaaccctcatgatactcaatattttacatatatcagagtttgtaatttccataacttcatttggtagttagacatatagacagagaagataataatatattcattatatatatatttatgtattatattcattatatatatatttatatataatattcatattatatatatatgtctataacatatagacagagaagataataatatattcattttatagtttaggaaacagacttggaagggcaaataacttgtctaagatgactaagcagctgagtgagaaccacagcctatctgtggcattcagtttcagccatctttcccttgcttcataaggatagttactctggtatcagttgctggattgggattttgggcatttataaatgtttttattttggatattactgaatcacagacaatttcatcttagttaattaaaaattcatcttacgtgacacttgtctaaatcttaaaatattaaaattttaatgtataaggatgttaataatctttatattttaagagactatgaagtcaagtctagctaacttagatctgtaagtttttagctatggaaagcaattctattgtgtacaagtttcagcctgtgaagggaattcattgaaaatgtatagagatcagaagaactaacacctttcttgcatggatttttcttgattattggcagttaacaataaaatgttattagatcactggtgcttctgtgtggggttgagttttttatgatatcttctgttagacccataagggaggctgtgagttgttttctacatccttggaatatataagatcctcttttaaaattatattttatataagcacatgaaaatggaatgaaataatgaattgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatatacgtgtatgtatataaatatgtatacacatatataatatctggagcaaaaatgattatgttgtaagaacttttggaggttttcctcctcgtaaaattccgaagtggtagagttaacattctgcttttaatttatctacaaaaacatgtgaagaatccccaaataagattttctcatagaagattcatggattttgagtctcagaaaaaaaaggaagaaaaaaacttcatggtataaaacaactaaaaattaaatatagtctttagaaatgattttgtttagtataaataatactggtatgacaactgaatgcaattgaaattatgatataaaatttctattctgctttgtatttttcattaaagtttttataattgtcatctgaaaaaggatttaatattcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctaaaattggaaaatgaatattcagatactaagagtaaattttttttttttttttgagacggcatctaactctgtcacccaggctggagtgcagcggtgggatcttggctcactgtaacctctgcctcccgggttcaaattattcccctgcctcagcctcctgagtagctgggactacaggcccacaatgccatgcccggctaatttttgtattttttggtagagacggggtctcaccatgttggccaggctggtctcaaactcccaatctcaagggatctgctggcctcagtctcccaaagtgctggaattacaggcgtgagccactgcacctatatgacatacttgaaaaaatattcttgggccgggtgtggtggctcacgcctgtaatctcagcactgtggaaggtcgagggtggatcacctgaggtcagtagttcaagaccagcctggctaacatggtgaaaccccatctctactaaaaatacaaaaattagctgggtgtggtcgcatgcgcctgtaatcccagctacttggcaggctgaggcaggagaactgcttgaatccaggaggcgaaggctgcagtgagcagattgcaccactgcactccagcctgggagacagagcgagtctctgtctcaaaaaaaaaaaaaaaattctcactttctgttgttgttgtttgtttaatgattaatagacgatttatttaagcaagaatacatagtcatcattgccagacttaatatgacaggttaaatgttggacccaattttccttcccagataagtttttctttcctatccctgtcagttttgaaaacataataccagaagaagaggggcccaattccacacagagctcccaagagtgagtttttaggagtgggtctgaaattaggaaagacacttgctgatcttgcataggtccaaggaatcaaggcaggattttcgatgagccctcggcagttagggtaagcaggtttcagccaggctcttaatggtcaaccacttggcttgcgcctgctgggtttccgaagacatgtcctattcggctggtttgagggcatagtggccaggggtgaaggagtatactttgggaacgacatcttggcgacccagtgcacaactcacttttttttggaaacgaggttggctctgtcgtccagactggagtgcagtggcgcaatctcggcgcactgcaacctccgcctcccgagttcgggcgattgtcctgcctcagcctcccaagtagctgggactacgggcgcacaccaccacgcccggctaaattttgcatttttggtagagacggggttttgccatgttgcccaggctagttttgagctcctgggctcaagcgatctgcccgctttggccttccaaagtgctgggcttacaggcatgacactctgcctggccagatttttgttaccctgtttagatatgatggtaactgaatgatcatgcaatctctgaccatgtgacattcagggataccaaaaatgacttgagatgggccaaggcagaattggagaagcatactttggctgaatacttaggccaaagtataatttggaacatttcttttaaaaaatctactcccctatgcctcccagttgcagtaccttacaattacagttaatctagtagcagatacttgattgggatattaggtatttacagaccaaatgcccattgggatattactcggtaacaggcagtttcactctggttcattgtagattcatccagtaagcatttctagagaactgctatatgaaaatattgtggaaagtatcaactttttaaacttttgatgtcatgacacctagaagattattttctgatactcatattctaagggaattttattttctgagatttgtttctgtggaatttttagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggtaagctaattctgtttggtttattcatgcaatagtctgtctctgcttatgacataaagtataatatattttaggaatagtgtggttttcttcatgatgtcaaacatacaagcttatggatatatttaaaaattcttaattttctagattaatgttcagcactacttcttccatcttgcattggatgggggcagataattaataattatcagatattttcttatcaaaaacaaatttgttggaaaaaaaattttttttttttgagatggagtctcgttctatcacccaggctggaggtgcagtggcgcaatctcggctcactgcaagctccacctcccgggttcacgctgttgtcctgcctcagcctcccacgtagctaggactacaggcgcatgccaccatgcccagctaatttttttgtatttttagtagagacggggtttcactgtgttagccaggatgctctagatctcctgacctcatgatctgcctgccttggcctcccaaagtgcggggattacaggcatgagccaccgcaccaggcctcaataaaatattttataaatacctttaaggaataatacaaacacaaccagagcttaaataaataaatgtaaatcaatctgcttgctggttaagtaatgagttcagtgtttccgcacagaaagtgggagagatagatgaagaagaaaataaagcttattacatgttgggaaggattctaggcactaagttcctttttttgagacagagtctcattctgtcgcccaggccggactgcagtggctccatcttagctcactgcaacctttgcctcccaggttcaagagattctcctgcctcagcctcccaagtagttgggactacaggcacctgccaccatgcctggctaatttttgtatttttagtagagatacgggttcaccattttgaccaggttggtctcgaactcctgacctgaagcgatctgcccaccttggcctccgaagtgctgcgattacaggcgtgagccactgtgcttggccagttctaggcattaagttataattggttcatttggggactcgaaattctccattttattttattttattttattttttctgcttttgtcacaaaagcacagacattgcttaacaaagaggtctgagacaggatatgaatgttaagctcagggacatagggtcaacacttttgagtgcacagactgggaacctggcagagttttaacaatcccctcccctattttcaccatcccttagtcctgtagaagtagagcagatgattacgtattcactgctgtatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgagacaagaataaccagaatgatgataaggagacactggaagtcactttagattgatgaccaaagatttccttattctgaccaggaggtcagatctcaagggtccttctgagtccacttttgattagccaaattgtcttttctttcagtttgactataggttagtcaaccttccctccacattcatcagggactgttagcaatatgtcatatttttttcttggtgtaccattaagcaatctaaagctatgctgttacctgtaaccacttggattaattattttagattagttggttatacttctagggctttatggctttatcttttcagtcagcattattaaccaagttttgatagctttttcaacttttgtaacccccatccagggagatcagtgtcctctcagacacttccaggtaagcatgatctcctggaagacatgagaagtctcttaaattgtctaattattacattggagctacataataactccaatatacctggagttattatgtgtatatgcaagttaggttctaatgaggcaaatataagtaaatatgttgttgattcaggaggtaaaaattaggagagccacgtgtagttttaaaaacaaaagaggaattacttgtaacagaagtaagtaagaaaggaattctcagttatctcttgggtagagataccttgcatagagttcagcaaaaattgcaaaggttgtcataggactatggaggccattaggctaattaaaatttataatattgcccatatatttgtactaagtctcattcctgaaggattttatatttgggttgaggctttgagaaattctaagactggcttgggcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttggagactattgatactcatcagattttaccactgataatttttcaagaggaactgtttatgaaactataaagagaaaatggagatacaaaaagccatccaagatgtaaatgccgaaggccaagttttgagataaacagaaaatcacaaaaactcatgtcaggtggttcttccatggccccagtgtgagcagacagtattttccttgaggagaaatactagtttggtgggggtaaggtagggagttaaactttaaggattaatcaagagaactatacatatgctatttaggttgagggtaaagatcagagtaggcatgggcaacgcctagactcaatcaagttacctatcaagcaagctgacatattcagacaaagcaagactccatctcaaaaaaaaaaaaaaataaataaataaaaagaattccttcattattttgtcatgctttaaggcccaggacaggcctaggcaaaagttttgatggccttttgttacatcccagcctttgtataagggcactggcttttagtatttaacttcattcagtcattactgaaacagttgttatggaagtctgcattagtgagacctggcctgccacaggaggttgcagtgagctgagatcgtgccactgtactccagcctgggcggcagtgtgagactctctcaaaaaagaaaaatgatgcagaaagatttgtttgacacagagtgggcataaactttcaatttgtcaaaaacatagtatctgtgaagtacaataaaatgtagtgcaataaaatgaggtatgcttggatagcaaaacatcatgttgtacctagtaaaggtatacaatttttatttgtgaattatacctcagtaaagctggacaaatgaactgtatttgcaacatggtaggaatatatgacattggacattaatgcaaatggaattttcagtgccatggtgaaaatgttataccactgaacaaaaaaaaagtagtgtgaaatgaagtaaaatgtgaaaatccgtaataaatgcagaaatatgaactgcttatccaaaagagaaaagtcttttgagttcctcaagaagattctctctttggatgctgggcacggtggatgccgggcacctgtatccgagcactttgggaggctgaggaagatggatcactggaggccaggagttcaagaccagcctgtccaacatggtgaaaccccgtctctactaaaaatacaacaattagccgggtgtgatggcacgtacctgtaatcccagctactcgggaggctgaggcacaagaattgcttgaacctgggaggcagaggttgcaatgagccgagattgcgccactggagtccagcctggaccacagagtgaaactccgtctcaaaaaaaaaaaaaaagaaagaaagaaagaaaagaaggttctctctttgggcactccttttcaacatattcagcataaatgaattaatgataccatttttactaggtgagtgtgtttgggcaagttgcttcagtgctcattctcttggtttccttttttttttttttttttttttgagacagggtctttctctgtcacctaagctggagtgcagtggagtgaacatagctcactgcagcctccaacacctagcctcaagagatcctcctgcttcagtctcccaaatagctgggactactggcatgtaccaccatgcctggctagtttttaatttctctttttttgtaagcacagggtgttgctatgttgcccaggatggtcttgaactactgggctcaagtgatcctcccacctcagcctcccaaagttttggattacaggcatgagccatggtacctggctgtcttttgctttccttatctgtaaaaactgaggataataacagtacccttacaaagttggtggaagaatgatattagttaatacaaatgaagtgctaacaaaaagagctttggaacacagcaagtacttgttaggtatggctattgtcatcaacacacttttcaaggcaaacttgtggtttcacctatcacctgagatatatgacttctaagttcatcagatcttctcttttggtttttatttttaaattaattaaatattattattcttattatttgagacagagtctgctctgtcacccaggctggagtgcactggcacgatcccagctcactgcaacctccacctcccacgttcaagcaattctggtgcctcagccatccaaagaagctgggattacaggcgtgcaccaccatacccagttaatttttgcatttttagtagagatagggtttcaccatgttggccaggctggtcttgaactcctggcctcaagcaatccacccatctgggcctcccagtgtgctgggattacaggcgtgagccatcgtgcctggccctcttttcattttagagataggaatctcattctcttccagaggctggagtgcaaaggcatgaacataactcattgcagtctccaactcctgggctaaagggatgttcccccctctgcctttggagtagctgggcctcagaactgtgccacaactactggcttccatcaagatctctgtcctaccatttcatcttcctactaggctatccccacatggatagataaatggtacctcaagtgaaagaaatcaactacctaaaataggattttccactccaaactagattttctttacatgtcatttctgttaatgtgggccacacacactggtaagctcagaatcatctttttcttttcttttattcacatccaatatggttgaaataaaacaaaatgctgtttttccttttttagaaaggcaatacttgttcattatatcaaaatttagaaaatatggaaaaacaaaaaggataaaaaattatccacaaccaaaatagcccaaatttccagttaaaaatatcaacgcatttgatatttgtccacataattaagactgtaatgtttacacaaatgtgagcttttaaaatctaaaaggctctcactattaaaaatgttttgttaaattttgttttaaaagtaagattttaatatccaaattcccaaaatagacatttttgaagatttggaaaatacagacggctgaaaatctttacattattactgttaaattttggtatgttctgttattctgctagtgaaatatatatagatttggggggctattccttttccttttttttttttttgagacaagtgtctcactctggtgcccaggatggaatgcagtggcgctatcacagttcattgtaacctggaactcttgggatcctcccgcctcgacctcccaaagtgctggggctaccggcttgagccactgtgccaggcgaatggctgttcctatatacacagttgacccttgaataacatgggtttgaactgcctgggtccacttataagctgacagaaaatacagtattggaggggcctgcatatagagaggtctgacttttcctctaagtgttccacccgcaggactgactgcgggatttgagaatgcgctttgttttttttttttaggaagtcttactctcgcccaggcttgagtgcagtggcgcgatctcagctcactgcaaccctcgcctctcagtttcaagcgattctcgtgcctcagcctcccgagtagctgggattacaggggcccacctccacgcccgggtaattttttgtatttttagtagagatgggttttcgccatgttggccaggctggtctccaactcatgacctcaggtgatccgcccgcctcggcctcccaaagtgttgggattacaggcgtgagccacggcgcccggcgggcaagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacgtcgcctcggtgcagggctccgccccgtcgcctggaaaggtgagtggatctcgaagagaccgacggcctcgacctggccgggcggcggcctcgacctggccgggcggcggcctcgacctggccgggcggcggcctcgatggctcaggcgtcatggctcccgacgggcgctgctccctggcgcgctctgttgaggcgccggcctcgacctggccgggcggcggcggcggcctcgacctggccgggcggcggcggcggcctcgacctggccgggcggcggcggcggcctcgacgtggcccggcggcggcctcgatggctcaggcgtcatggctcccgacgggcgctgctccctggcgcgctctgttgaggcgccggcctcgacctggccgggcggcggcggcggcctcgacctggccgggcggcggtggcctcgacgtggcccggcggcggcctcgatggctcaggcgtcatggctcctgacgggcgctgctccctggcgcgctctgttgaggcgccggccggctggcgcagtcctgtgggcggcgtggcgcttgcaagcgcaggaagagtcctggggggaccgcggtgggcgggatacctttggcgccggatcttcctctttctcccggtttgttcccgacggtgctcgctcgtgggcccgccctggcccgggctttctggccccatagtacccgcgcggcctagttctcgggggcttgggcacccgggtgctgtatcggcgggtttcttcccatgtcctggacatttactttatatgctgcggcggaggtcgtacctccttggcctggaggaacccagtggggactgacgcagctccgggtgagctttggcggctgtgtcgagtgacaacgtaggcatctcagcacggacatttgcagtggcccgacggcgcaaatgacaggggaagtccccttgttttgagtatgaggtgtttgtcgctgtccctttataagggtccaactccactcatactcacctccctcgccccccccccaccccgcccagaacactttggtagctgcctttgcttaaaaaaaaaaaaattctaaagttcttacaaatcgttagtatggcttacaatttttaaccttttccacaaatgtttttagggtatttttcctctttacaggtaaataatgtgatctattttggattcaataagactttagtaattggatctaaagagtgacggaagaagctattaaaggtggatgtgcacagaatcttgagtcagtttgctttggcttgaataatcacagcactgtcgtttataagctgggtatttggggccagttacacttttcatccatagatggagttgtaacattaatagaatttgataggatgatccattttaaacatttagggtattgcttgacacatagcactaagtgttagctacaagtcactgtttttattgttgatgttaaaaggatattggcggggcgcagtggctcacgcctgtaatcccaccactttgggaggccgaggagggcggattgcctgaggtcaggagttggagaccaacctggctaacatgtcgagacctcgtctctactaaaaatagaaaaaaagttagccgggcgtggtggtgcacacctgtagtcccagctacccgggaggctgaggcaggagagtcgcttgaacccgggaggtggaggttccagtgagccgaggtcgcgctactgcactccagcctgggcgacagagggagactccaaaaaaaaacaaaaaaaaaccaaaaaacggaaactcaacggatgaccatgattataatagtagcataattgtgtctcttatcataactaagcatacgttatcttattttgcgcttccagcaaccctgtggatattgagacctgtagagatttaagatacttgttcagggtgaaataggtagtgcagcagaattttggcagtgggtctgatttagtttctcttgggaacagtggagtaagttacagtctattcctccagagaagaaggatagatatctacttgtacattgtaatttcaaactgctagcatagtataaatatgaatgtgatgatagagtctaaaacagaccttaattgagggttcctgtaactcctgaaattaaagactttaatttttgtgttatttttttttttttaggtggggtctcactctgtcacccagctggatgcagtggcgctatctcgactcactgcaacttccgcctccccagctcaagcgatcctcccacctcagtctcccgagtagttgggaccacaggtgtacccaccacacctgctgttttgttctgttttgtttttatttttggtagagactgggtttcaccatgttgcccaggctgttcttgaactcctgggctcaagtgatttccccgcctccacttcccaaagtgttgggattataggcgtgagccactgcactggccattattttatttttgagacaaggtctctttctgtctcccaggctggagtgctgtggcaggatcgtggctcactgcagcgttgacgtcctgggctcaatccatcctcccaccttagcctcctgggtagctgagactacaggcatgccagctacaggcatgcgccaccatgcccggcttttttctttaatgtagagacggggtcttaccatgttacccaggctggtctccaactcctgggctcaagtgatcctctcgccttggccacaagtgctgagattacaggtgtgagccactctgctcagcctgatttttttttttttaaacaagcttaaaaaaaaaaaaagcatgtttagagcctttctgagattcttagtggggatcttggcttccaaaagattaaaaaccactggtctagacagaagttagaatgttctttcaactacataacgtctccattaaataaagtggagtggtagcaacattttgaggattggttattatgaccacctctcttacacttagagtcttttttttttcccccaaatttaaagtcatttacattagaacctggggatttcagcggaatatggattaactagtgagtaactttggaacatgtgaagctattctgtaaagttaggtttgagtgaaatgacaaaacagggtgctttggatagaaggtaaggaatggagggagaagaggcagtggctgtgaagaatataaagaggttaatattctcccccagtttggcagagactggccatctgtgaactgcccatgctttctagaatgtctgagttttggagtgtgatgatgcgtctgtatatcatatctttctagtcttccattgtgctttcatttgttagtcttctcttgttttgccatttttgtactccctcacatgtgcttttgcccttcttaaaaatattcttcgtctgtaatccaagcactttgggaggcagagagaccagcctgaccaacatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcgccactgcactccagcctgtgtgacagagcgagactctgtctccaaaaaataaaaaaataaaaaaatatataattctttctctagtttttctttttccagatggcttctgtttagtttttctatgttctgtcaagttggtttcttattctgcagctgattcctacttctcaaactctacttgacagctcttatttttatttatttgttttttagaatagggtcttgctgtgttgtccaggctgccatcaaatttttgggcataaatgatcctcctacctctgttgcctgagtacttaggactacaggcaggcacctttgacagctgttagttgttttttctgccctttacatctatacttcatgcttctgagtaacacacacatatacttttgttattttgaattccctttctcccattttagacattttgttttcttttttttttttgagacagagtctcgctctatggcctaggctggagtgcagtgtcgcgatctcggctcactgcaaactctgcctccggggttcacgccattctcctgccccagcctgtagctgggactacgggcacccgccacaacacccggctaattttttagtatttttagtagagacggggtttcaccgtgttagccaggatagtctcgatctcctgacctcatgatccgcccgcctcagcctcccaaagtgccgggattacaggcgtgagccaccgcgcccggccccactttagacattctgtactggctattatgctcctccaaaactgtcctcagacactttgctttgcccctcattgtttcagtactgttattggagtttttgtttaaatgaatatttaacatttatataaatataaggtaaatattttgcatttgaattgcccttgttgtgcagttttgtttttcctggactgaataattgctttattttttggtttgcttgtatgttgtgttactacttggttacttaaactcagcaacttaaaccctcaaatgtggtcaaactggtcacataatccgatcaatttcagcttaaaacattgattgattgattgattgattgattgtctgtctacctggaatacccttactaaccgacttctccaacccagattggtttttcttcctctttgctacacagctgtgctcttgggacttccctttatcaccagtttgagaattcccttcatcttttttctgagttagaccctttgtttcttgtatctcatgtcatcttcatttactttctttgttttggtgtagcatagttcacttgctttgaggaaaagtggatgagaggtttttttgtttgtttttgttttgggacagagtcttgctctgttgcccaggctggagtgcagtggcatggtctcagctcaccacaacctccgcctcccgggttcaagtgattctcctgcctcagcctcccgagtagcgggattacgggtgtgcgccaccatgcccggctaattttttctatttttagtagagatggaatttcaccatactgttcaggctggtctggaaactaatggtatgtctttaaaacatctttacttaatttagttgatcatttggttatcgaattctgagtttgaaataatttttttcgcaattttgaaagcattgctccattttccagaagttctgttgttaggagtctgatgagagtcttgttcttggtaacaaaggttttctggaagtgtcctttcaattgggaaactcatttctttcagttctgtagcgtttcttgtattatttctttgaccatttcttaccctttttttaatgatgtttacctgaaagctggagtttctctaatttttctcttattctcctcttttgtttgttctgccttttgagagatttccttacccttatgttccaggggaagaagattggggaattcatgtttcagtatctagacttttcctcattgtcctgtataatcacggccttcacccttgttgggactccacagatttggagctgatcagatcggtttgttgagaacagcagcttttttggaggattttagggggagggagattcatttgactgtgcaagatgggcgacagagcgagactccgtttgaattaaaaaaaaagagagagaaatttagaactgcataatgaaaaagtaggccacaaatgttaagttttggacaattacaattacatctctatcttactgtgcaagatagcgatgatgtggcatctcttagggtcttactgttcctgttttcagccctgcatcagttcttgatatttggcagcttaagtgaattcaggtatttgcttatagtgacatctgctgtcatgtaaagaagtactgcttgaatcagatattgtcctgtttacataacgtgggctgtgctccttcctagctgtatatctttaaacaaggcatttgcctgcttgagcttcagttcccttgtaaagtgaggttagaggcaaaagatcatacagaagaataatttgtaaagttgtttaattatcttaagattgtctactttaataacatagttggaagcaaagaaggtaatggaattatttttctattatgttttggcattgtaccttgaatctatttcttcattttgaaaagggggaactggccgggctcggtggctgaggcctgtaatcccagcaccttcggaggcggaggaagtcagattacaaggtcgagagaacgacaccatctggccaacatggtgaaaccccatctctactaaaaatacaaaaattagctgggcatggtggcgtgcgcctgtagtcccagcttgtacccgggacgcagaggttgcagtgagctgagatcgagccaccgcactccagcctggcgacagagcaagactccatctcaaaaaaaaaaaggaagcggggaacaagccttgttcctttatgtgctgtcctgactgttgtgtattatttttgttaagattgctatagttcttttttttttgagatggagtcttgctctgtcgccagtgctgggattgcaggtgttagcctggcattgagcaacgttttgtaatttaagcatacaagtctctcacctccttgtttacatttattcccaggcatttttttcatttagatgcgattgtaaatggaattgctttcttaatttccttttctgattgttcgttgctggtacagtagtcccttcttatccacagtattgccttacgtggttttacttacctgcgtcacccgtggtccaaaaatattgaatggaagattatataaataaacatttcatgagttttaaattgcaaacagttctgaataacatgataaaaatctcacagcctcctgctccgtcctacccaggacacgaatcatccctttgtccaatatattcatgctgtatgtgctccccacccgctagttacatactagccatctcagttatcagatcagttgttggagtattgcagtgcttgtgttcaagtaacccttattttatttaaaatggcaccaaagagcaagaatagcgatgctggcagttcacatatgccagagagaagccatatagtgcttcctttaagtgaagaggtgagtttttgacttaggaaagaaaaaagatcgtatactggggttgctaagatctacggtaagaacaaatcttttgtccatgaaattgtgaagaaggaaaaagaaatttgtgctagttttgttgtgacaccccaaactgcaaaagttacagccacagtgtgtgataagtgctttgttgagatggacaagacattaaatttgtgggtggaggacacaaacaggaaacatgtttcgattgatggcaacctggtttgatactgttcatcgttttggacattcactggggtcttggaatttcaaaaataagatgtttgagtggctgtatactctttatcacatggatggaacatactctggttgtatcagcttttttttttttttttttttttttttttgagatggaatcattctgttgcccaggctggagtgcagtggtgcggtcttggcccactgctgcctcccgggttcaggcgattctttgcctcagcctcccaagcagcggggattacaggcgtgtgccaccatgcccagctaatttttgtatttttagtagaaaggaggtttctgcatgttggccaggctggtctcgaactcttggcttcaagtgatccacccgcctcagtctccgaaagtgctgggattacaggtgtgagccaccgcacccagcctggtgtgcatcagcattttggactttggagtttacgtaaccaaggagccaggctgtggaccttgtttattacttgaagaattcaatatttatttctgcctttttgactccttgactgtaaaatactgatctgatctgtagagagaacagtacatgtactattaaggcacagggaatcctcagtgccttaatagatcgtaagtacttacttattctttcccatagaggcttacacatggtaggagaagagatttctggaatacctttcctccccaaagaaagctggtttcttttgtttgttaagtgagagagtggtaccacagggtttccaagatttccaaggctgatgaaaattcttaacttctgttgtctgcttgtcttgctttcttgaatttattttttgtatgttatgtatttattatttagagacaggatctccctgtgtcacccaggctggagtgcagtgtcacagtcataactcacggcagtgtcaacctcctgggctcaagtgattctccttccttggcctcctgagtagctaggaacacaggcatgctccactatgcctggctatttttttccccctggagacaggatcttgttgtgttgcacaggctggtttcaaactcttggcctcaaagctagcctcccaccttggtctctgaaagtgctagaattaaatagaattaaaggtgtgaccaactgcacccagcttatttatgatgacgatgatgatgatgtttgggagatggagtctctgtcgcccaggctggagtgcgatggcacgatctcagctgactgcaacctctggctcactgcaacctccacctcctgggttcaactgattctcgtgccttagcctcccgagtagctgggattacaggcacccgccatcatgcctggctaatttttctatttttgtagagacggagtttcaccatgttataacgccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcaggctttaaaaaaaacttttaagtgaatgaaaatggcatatttgaacataaacttagggcagatttttactacttttgaaaaaatgttggagaatatttctgtatgaaacgtaaaacaacttttaattttttttagaagttgagaggattctattttgcaaagctgtattatgaagctaaagaatatgatcttgctaaaaagtaagtacaaactgtaacatgtattctttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttaaaacactttttctaaaaattgtcttctgttggagtaaaagaggaccatgcctatatcttcatttgtttttggttagatatctgataccttaatcagatggaaaatagcaatgaataaaaaactgtaattgtaaggcaggagaatagcttgtataaaagatctttaattgacacaatatgtgatgctctaaggctctatcctagggataagaagcttggtgattctgatttcctgactgggagtggattaaagcaggaaattaagagggaggcagggtttttttttttttttttttttttttaggcagtatctgtctctcttgctcaggctggagtgcagcagctggctccatctttgctcactgtaacctctgccttctgggctcaagagatcttcccacctcagcgccccaagtagctggggatacagatgagcaccaccacacctggctaaggtttgcattttttggtagagacaggtgtcactatgttgcccaggctagtcttgaacttctgagcacagcagtctgcctgcctcggcctcccatactgttgggactacaggtgtgtgttactgctcccagctgggaggcaggcttttaaaggcatccaaaggaagatggaaatgctggtaagaaaggaaaatggtggtacataaattatgtaactagcagcactgtgactgttaactcttgtacctttttactgtgagactttaatcccttagtttgggtctggcctaatttctctgatggtaatactgtcaaggaacctagaggatatttacttattttagttgttacttgatttgagaaatggaaatttcctgtatttggtactgtaattagtaatttgtcttctgttcgattttagctggatatagtactgttagaaattactttcttgcttaaagggtaggtgtatttccctttgttgtttgggaaattgttgctgtttagtattttgcattatgataactttaaaaatgtttactataatcacttctaatttatttgcaaaactgttagtgctttattaaaatgtgatcaggaagaaaaagcaatttatatgttcatttcttatgcgtggataacactggagaaaaatttggtaaatgtgacatttaatggtaaaacgagtatgtggtcaactctatgtacgtgtttttaagtattacccatttctttctatgaatacttctgagttatctgcataaatagtggtagttttgagtaacaatataaacgagtttagtggttgctttggtttaagatgtattcttcggttagcatttaaaagtacagttctaagtttaatttacttttgtattacttttgaaaaacagatacgtatgtacttaccttagtgtgcaagagagggatcccagagctcacagatttctgggtcttctttatgaattggaagaaaacacagagaaagccgttgaatgttacagggtaagttataggattcaaatatagcctttgcatagccaaacacatgatgcccagagaaatttatataagtaagtcaaatatattttatgaatatcataaaacaggcattggtatcatagtacaattatgtgacacagcttggaacagatttagaattgtttaacacctataaattgtaagtctaacatggtcagaaatggtgttcttttgtgttcttttgcattcaaatgacacaaatataatttttatttgattcatttccagaaaattccaagacacttttattttaacacctttgaagtaacatgttttctctagaagtagaattttttaagggttggagtgataatttttaacctttatatataagtatataagtatatatactcctacatacatacatacaatttatttactaatctttaatttcttttctgatattagcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggtaaacatacaaaacataaagggagaaaacttaagacataaccatttctaatatttggagtttaaattacttttcaatagcaaaccttaagcccaggtgtttgtgtttcctttaacatttttcttttaaaaagtgtattaaaacctttctgagcatctgctgtcttattaggcattgttatactttataagtgacatctcatttacccttctggaataattaatattttagggattttacagtttagtagctgtaaactaagtagagctaagatttacattaagttctgtctggtatacaatttttgcttcattaagtgaaaattacctacaggatgacaatttagggatattttaaagaagagttttctaataactatggtctgaaagtagaagggattgtattttgagatagtaaagttttcaaggaaaagataaaaggtggtttctctagtatataagatgtaattactaaaaatggtaggaagttcttgctagtgtattgactggtcctgatattctttatagagcaaaatatagtttactaagtaactgttctggagaaaatctacacaaatatgtttggcaaacatttaaaatgtatattgtaatattttatatattaatgtatactttattgtgtatgtacaatataaaattataaatgtatatttgcctttagcctcctcctacccccattgtatatgtttctgatagaaatttaaaaaattttaattttgaaataattatagatttttttgcacaggaagttgcaaagattgcacagaaagatcctatatgctacttcatttttccccaatgcttatacaggttgagcatttaaaatctgaaatcctaaatgctccaaaatctgaaattttttgagcactgacatgatgctcaaagaaatgctcattggaaaattttggatttcagattttcagatttgggatgctctgcctgctaagtatcctgcaaatattccaaagtctgaaaaaattcaaaatctgaaatacttctggtctcaagcattttggataggggatactcaacctgtttaacccgaccaaagcacaatatcaaaatcaggaattttgacattggtacaatgtgtatgtatagttttctttcattttatcatgtgtagattcataccaccactactgtcaagatacagagctactctattaccacagagatcttcctcatgctgccccttttgtagtcatgctatttacttctcttcactatgcctgacctctggcaaccattaatctgttctccatctttatactttggtgatttcaaaatgttatgtaaatgtcatcatgaaatgtgtgacttttttttttcttttttcgttgtttttgagacggagtctcgctctgttgcccaggttggagttcactggcgcaatctcggctcactgccacctgtgcctcccaggttcaagcaattctcctgcctcagccttccgggtagctgggactacaggcacatgttaccgtgtcccgcttatttttgtatttttgcagaaacggggtttcaccatgttggcctggctggtctcgaactcctgacctcatgtgatctgcccaccccagcctcccaaagtgctaggattacaggcgtgagccaccgcgcccagccaagcatgtgaccttttgaggttggcttgttcagtcagcataataccatttgtgatccatattaagttttgtatatccatagttggttcctttacttctgagtagcatttcatggtccacaatttaaccattcactttttttatttttatttttttgagacagagtcttgctctgtcgcccatgctggagtgcagtggtgctatctcggctcactgcaacttctgcctcccgggttctcaggtgatccacccactttggcctcccaaagtgctgggattacaggtgtgagccactgtgcccagccttaaccattcacttttgaggggcattttggttatttctaggttttggctgttgttcaactgctatgaacaatcatgtccagatttttgaagctgaaaaagcattgaagatgcttccaaagataaatattactgataagtttttctccccagtaataagcagctggattttaaatattagtctaaaacatgaggtctaattgtgcagatttctttactctcttaggtgttatgcctcaaacataactcccatattgggcgtggcaatccagttaatctggtgtcagtagtgttaaagaacatatgtaatggcaggagattgttttcttgcagtgtaacaagtaagatactttgaagcactctttaaagattttctttaataacttgaaggcactgttaacacctttcctgtatcagattttttttttttttggaattgaaatccatgagatttataattgtcatgcaaagtaattccatttctcctaaaatttaaggcttgctaaggtaaacagtttctgacatttgtttaatgaatgagagtattactgttgagaaggctttttctctcaagtatgagatagaactttttaaaagcactcatagtggttttttaaaaaatgtttaacatagagtcaaagactagggcttttgcaatagggagagaccagggtatcatccatctcatccagaagaggagaaattgataaaggagagaggggaatgaaatacagagtagtaatggacggcttggtcttgagagctggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggaggtgtgaagtgtcagggagtggagaaagtgagtctgttagtactaaaatggcattttgttttaggcagcaccagtttgatggttgagataatgcaaatgaaatcagttagcttggggttatgatttcccaaatctaagcacacagaaaccagttgggagggttctgaggaaaagagggaattagttgaagggatctgtaagcaaacagtaattatggatataagggattatagcattttttgcctgacagaagaaagtgtgtgtatatgtgtttacaggtgcttaaaacttgatgatgttattgtcttgaagggaacttgtcatgtggtggagaagtatatttctgaaagtaagggtacgtaggccctcagtgaggtggaagaataagaaggatggtatggtcgtttcggtggtatgaccaaaatgcagattttgaagacctgtgtcagtggcaagtggatggttgaggttggagtagaggataacatgactggagatgaggtgattaaggaactgagtagtcagcctgggcaacacggcaagaccccatctctacagaacgttaaaaaaaaattagccgggcatggtggtgcatgcctatggtcctagcttcttgagaggctgatggaagagcatcgcaaatgagaagcgagtggccacaaaccctacttcctctccttgtatgtaagttcagagagaaaaagccatcatggtagtgggggttatcctgagatgatactgtcttcatttaagatcaggaggtgatgacagtgctttgagatgatgatgaaggtaacagaacagtgggaggagaggggatgtgggattgagtcagatttaaggagatacagagcagtttgagcataaggaccttgttgctgaggattgactggggaggtctaggcttctggtggtgactcagatggacagggatgtgtggcaatagtcctggtagtctctgaagagagtatgagctactgcagtaatcacagatgcttttcttcacatacagttcttgaggcttagtttctgggttgtaagcaactctcagaagggacgaataaggtatataggatggtgtttttggtggcatcatcataaaactagacatagtggaatggtgctttttgggagcatgacttgtttaaaattgcacaagtgttactctaataatttttctttttcccctctaaataggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggtagataaaagctattgggtctttacatttctatgtaggcaattagcatacatctttttgtactaaagcagcagtgccccgcaggacttaaatttcttttatttaggtagaacagttataaaatgaaatttttaccaggatcagttaaatttataatgggaaagttggggagataactatgataaatgtatatatttttggtgttttcatttataaggttgatgtaaaaatcaatgtagtttcacaaacgtggttagagtgagaaaaggaatttgtaggcataaaatggttaatttcttaacacttgattaagttttgtaacttactattcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactggaaaggtgcgttgactttgaggagaatgctttagtataaattgtagtttttctttttgcagtaagttcattgctctaaatttctttactgcatcattatttctataatgtacctaggagttatagttaatacagtgaaccactaggaggcaatcttatttttcttcttttacggggaagttctaattggttttatatgactttcctttttagagaactcttatagttcaagcttgattaaaattagccttatggttaaatactcaggtttgtcatagtcaagcttaaaatgaatgttctaactgctatttcatattttattttttataatagtataatcttgagtgaaaattaaggttcatctgtcatcagatggctaggttcacatgtactagtataagcacttagcatcactggtatttcagaaaatactgttttagctaagaaacaaaataactcaactatgtgatttaccttttttcctaaattttgattttgaaaaccagtgtctccattttgaaaataaattccattgaacaaaaacatcacttggatttgtataaaaatgttagtttagagcaggggttggttagaacttgtgggccaaatatggcccctgcctaattttgttaatatttattggaatgcaacatgcctctgtttatgtattgtctgtggctgcttacatactacaaggttggaattgagtggttgcagcagagattgtatgcctgtaaagccagattagtaatctcctcctttttgtagaaaaagtttactgattgctagtttaggctgtccatttgtttggaagttaatttatttccccatctggtataaggaaagaagttcatttcactgagtgcagggagtaggtaattttcttgaaaaagtacatagtgtcctaaattggtagggtaagagcagtatctaaaagaactaacataactttaagattattttagaaaacatgtaggatgttttattttgtgttctttgtatactcaaattttttggtcacaagttccttttacatttttcttaaggacatcaaagatctttgtatgtgggttcctttttttctttctttctttcttttttgttttgtttttttttttttttttgagatggagtcttgctctgtcaccaggctggagtgcagtggcatgaccttgactcactgtaacctccgcctcccgggttcaggcgattctcctgcctcagcctcctgagtagctgggaccacaggcgcacaccaccacgcccagctaatttttgtatttttagtagagacggggttcaggatggtctcaatctctctttttttttttttgagactgagtcttgctctcgccaggttggcatgcagtggtgcagtctcggctcactgcaacctctgcctcctgggttcaagtgattctcttgtctctgcctcctgaataggtgggactacaggtgcccgacaccacacctggctaattttttttttttttgagacagagtctcgctctgtcacccagcctggagtagagtggcgcaatctcggctcactgcaagcttcacaatttcctctcaatgctctgaataagagcttatcctcctgcctcaggttgttccccaccaggaagccccaggagggccctgaggacagcccttggccctcagagggggaggctcaggaggggagatgaccatggggatggagtcactcaggggagaatccggaccatgagggggtgactgggggcctgaggggaggaccctgaggaagataaaaagctggtgccaccctaggcagtttcacagtgtggcttagggtggtgggtgacagatggtttgtcagatcagttaatcaggactcatgggccctttgttacccccccttgtgaacctcccaggttcacgccattcttctgcctcagcctcctgagtagctgggactacaggcgcccaccaccacgctcggctaatttttttgtatttttagtagagacggagtgtcaccctgttagccaggatggtctcgatctcctgacctcgtgatctgccctcctcggcctcccaaagtgttgggattacaggcgtgagccaccgcgctcagcccacacctggctaatttttgtatttttagtagaaacagggtttcatcatgttggccaggatggtctcgatctttttttttttttgagacggagtctcgctctgttgcccaggctggagtgcagtggtgccatctcggctcactgcaagctctgtctccagggttcatgccattctcctgcctcagcctcccgagtagctgggcctacaggtgcccgccaccacacccagctaattttttgtatttttagtagagatggggtttcactgtgttagccaggatggtcttgatatcctgaccttgtgatccgcctgcctcagcctcccagagtgctgggattacaggcatgagccaccgcgcccggctggtctcgatctcttgacctcttgatctgtctaccttggcctcccaaagtactggaaggtctcaatctcttgacgtcgtgatccgcctgccttggccttccaaagtgctgggattgcaggtctgagccactgcacctggccgtatgtgggttatttctgtcagtgtttattacattagaaattaaaacaaataaaaaatgtaatccattaaaaatgtaataagccctattgtgtgttaataataatagctttttttttttttttttttttttttatttgagacggagtttgctcttgttgcccaggctagagtgcaacagtgtgatctcggatcactgcaacctctgcttcccaggttcaagcgattctcctgcctcagcctcccaagtagctggaattacaggtgcccaccaccacgcctggctaattttttgtatttttagtagagatggggtttcaccatgttggctaggctggtcttgaactcctgacctcaggtgacccacccgcctcagcctcccaaagtgctggaattacatgtgtgagccaccgcgcagggccaataatagcattttttatgaaaaataattattttccaacagcaaaaaagtagtcagaaaagtgtcattgtttttgcatttttgtaaatctttttaatgtctcgcttaatagaacatagctagattctcatttacttcctctttcagtctgtaaaactattacatgtcatgaagcctctagaaaactcagctcagcgggtcgcggtggctcaggcctgtaatcccagcactttgggaggccgaggcgggtggatcacgaagtcaggagatcgagaccatcccagctaacaatggtgaaaccttgtctctactaaaaatacaaaaaattagccgggcatgttggtacgcgcctatattcccagctgctcgggaggctgaggcagaagaatcgcttgaacctgggagtcagaggttgcattaagccaagattgtgccactgcactccagccttgtgacagagtgagattctgtctccaaaaacaaaaacaaaaaaactcagctctacatacatgagaaaatgagtatgtaatatataaatttttttttggtattattgtaaaagtaattttaacttcatggatcccctgaaggggtttttgagcaccctcagagatctttagacctcatttgctctggttgcgttattgtaagccactttaaaatcatgcttcacgtttaagtgtttgctttttgcttttacttttcttccaaagtgaggatttggagaaacattaggatttagaagaactaatttagaatatagattacaaataataggccaggcatagtggctcatgcctgtaatcccagcacattggtaagctgaggcgggcggatcgtgaggtcaggagttcgagaccagcctggccaacatagtaaaaccctgtctctactaaaaatataaaaaaagtttagcggggcatggtggcaggtgcctgtaatcccagctactcaggaggctgagtcaggagaatcacttgaacctgggaggtggaggttgcagtgagcttagattgtgccattacactccagcccaggcgatagtgagagactctgtctcaaaaaaaaaaaaaaaaaaaaaaaaaagacaatttatttaacgctgtaatgatctatatagtaaaaagagcaattgctgtattgatactcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactaatcttatatttatcctgtgattggagggctggaaataactgggaataagacatcatttgagaggttaagcatgaagtataggaagtatgcaggataaaaataagcattagatgattcataatttataacatggggaataagaattattagaagttgaatgtggaagatgaagcttgaaataaaatttttattttgttttgaattaaatgaaccatgattattcacagtgcagtaagtgtgtatcatctgtttgatattttcatattacagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggtaagtcttccacttgtaggagcaattgacatttcacggagtcttgatgtgttttaaatgaaggtgtgctctggtatgtaatgacaatatgtgaacaaactgtggaattaaaatgaaatagtcaatttgatacagtggaaaataactaagcatacacaatactggtgaggctggtgaaacagggatgttgagtgcactcttgtcgaaagcctgcattgccatgatttgtttgtagacaaatttgaagagtttgatctttttactctgccatttttgggaacatgataaagatgtaatctcgtattatgggtaaagcttgattcaaaaaggtgtgttacttggacaaaatcctaataagtagatgtagggcaatggctttatagcctatgatagaagaatatgattgcaatttaacatgttaattgaaacacatgtatataacatttatggctgtattgtgtatatgtaacagtatatctattaatctttgaaaacataaaaccttttcttattttttatttttttattttttttgagaccaagtctctctctgttgccaggctggagtgcagtggtgtgatctcggctcactgcagcctccacctcctgggttcaagtgattctcctgcctcagcctcccgagtagctgggactacaggcccgtgctaccaagcccagctaattttttgtatttttaatagagatggggtttcaccatgttggccaggatggtcgcaatctcttgacctcgtgatctacctgccttggtctcccaaagtgctgggattacaggcccgaggcactgtgcctggcgtgcctggcctttttttttttttgagacggagtctcgctctgtcgcccaggctggagtgcagtggcacgatctcggctcactgcaagctccacctcctgagttcacaccattttcctgcctcagcctcccgagtagctggaactacaagcgcccaccaccatgcctggctaatttttttgtatttttagtagagacggggtttcactgtgttagccaggatggtctcaatctcctgacctagtcatccacctgcctcggcctcccaaagtgctgggatttacaagcgtgagccaccattcccggacttttttttttaatgagcttgcataacttttgaaaggaaaagaaataagcagtcttccaaaaaaagcattaaaccaggcttagaaaaatgattaattttagagaaggattttttgcttggggagggaaaaaaaaggattcattacttttagagaaggcccctccttctaatataaatctttttttctttttgagacagagttttgctcttgttgcccaggctggagtgcaatggcgccatctggctcactgcaacctccgcctcccgggttcaagcgattgtcctgcttcagcctcccgagtagctgggattacaggcacacgctaccacgcccatctaattttgtattttcagtagagatgaggtttctccatgttggtcaggctggtcttgagctcctgaactcaggtgatctgcgtgtctcggcctctcaaagtgctgggattacaggcagtgagccagcatgccctgcctaatataaatctttttatttttatttgagacggagtctcgctctgtcaccaggctggagtgcagtggcgcaatctcagctcactgcaacctgtgtctcctgggttcaagtgattctcctgcttcagcctgtcacgtatctgggattacaggcacacaccaccatgcctggctaattttttgtattttttaatagagatggggtttcaccatgttagccaggatggtctcgatcttctgacctcgtgatccacccgactcggcctctcaaagtgctgggattacaggcatgagccattgagcctggcctgtaaatcttttaaaaacaccgttgatagacagttcacatgttaaatgctaatattggctcagtagaaacttctgtgttcataaggaatggattagtgaaaattaatggatttagtgaggttcactaggtaatacaaacattaaaaggttcttatagaaattctcaagtaactgatagttcttatttttatttattttatttttttttgagatggagtctcacactctgtcgcccaggctggagcacagtggcacgacctcggctcactgcaagctccgcctcctgggttcacgccattctcctgcctcagcctcccgagtagctgggactacaggcacccaccaccacgcctggctaatttttttgtattttcagtagagatggggtttcaccgtgttagccaggatggtctcgatctcctgacctcatgatccgcccaccttggcctcccaaagtgctggcattacaggtgtgagccaccgcgccctgccaatagttcttatttttaatggaaactttaaaatttatctgtctgtgtgtctattagagtcttgctgtgtcacccaggctggagtgcagttgcgtaatcgtagctcaccgtaacattgaactgggctcgagcttcccagagtgctgggattataggtgtcagctactgcgcacagcctaaaatttttcgatatgtagttttgggaggcagagtctcactcttgctctggctggagtgcagtggcatgatcatagctcactgcatcctcgaactcctgggctcaagtgatcctctcctgcttcagcctcagctcagtagctgggactacaggtgcctgccaccatgcctggctacattgttaaattttttgtaaagacaaggtcttgctatgtttcccaggctggttggtcttgaactcctggcttcaagtgatccttctgccttgccctcccaaagtgctgagattacaggtatgagccaccacacctgactgtgaacttttaatcataataagttagtttccctcttaatccattcactcaggtctcctttcctagatgacagctactgttaggagtttcttgggtgttcagaaatattttttgcatatgcaaatgtgcaatacattctttctctgcttttaaaaaatattgtgcctcaatgtgggtgtgctttacctattgccagatgccttgcttttctgaatgtttcttcattgttccacttcagcacagagatacctacctcagtctttattagctaccacatatttctgtagaatgaatatataatagaaacatcttagatgcttgtattttatttgatcagtttattttaaagcttaatgaacaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcgtggtggctcacacctataatcttagcactttgggaggctgaggcgggcggatcgcttgaggtcaggagtttgagaccatcctgaccaacatggtcaaaccccatctctactaaaaatacaaaaattagccacgcatggtggcaggtgcctgtagtcccagctacttgagaggccgagacaggagaattgcttgaaaccaggaggcggagattgcagtgagccgagatcgtgccactgcagcactccagcctggcgacggagcgagactccatctcaaaaaaaaaagaggaaatagtgaattgagatgatttgattgagtggattcacaactaattaactggtcacagattcaactgttgaataattttgtaaaagaggccgggtttatgaattgaggtcagtttgaaaacaaaaagaatgatgtcaacattttgtttcttactttgtgtgctcttttcaacatatagatgacaaactttgacatgatgtttagaaaacttgtgagtaaaaggataggcgatatgaatatttctaaaattcaaaatcagaagcttttaggttcataaatcatatattttgaaaaatgagcatgtttggaaagaattatatatacatggtttaaaattctggcggctcttaagaatatgctatgaagactcctttctgttccctagttatttactttctccagccccaaagaaactaatgttattgctttcttgtgtgttcttcaggaaatgttttatgcatctccaagtaaacacacatatatcccctgtctttaaaagaaggaggaaaacatttgaacattgcatttactttatttccattaactgtatcttggagatgtttccatgtcagtatatataaagggcattctcattagtttggatgcttgcatattattccattgtatggatgtactgtagttttggagtttttaaaaccagggtcctaaaaccaggacattagcttgcttttacttttttttttaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagtgggcattgcctgtgactggacgttttcagtgatgggcattcattacttttcaagatagcccagtgcatctttaggtggtttggctcttggtacttccttatatagaataaaaatattcttcaagccttctacctgttggtcttgtttcttcttttgatgatttcttttataaaataattttaatacctgaaggcagctgtcacgtcttcccttcgccattctattcatcatgctttttttttttccataggttattgcattaggatctctttaatttcctggttgtcccatttattctagtgctatcccctgttatccatactctgaaaatgtgttatctacaatgtggcatttccaagtgtcatttcacctgtactttttaaagtagggtgtcatatctactcaaataggacaacatctgctgttgtcctatttattcagggcagaaaagtaatataattaaattttccatttctctgaatgtaacacgaatgtgcttttagtagaaactaatttctcagagctgctctgtgtatgctttttttttttttttctttttttggagatagggtctcactctgtcacccaagctggagcacagtggcatgatcatggctcactgcagccttgacctcctggatttaagtgatcctcctgcctcagcctcctgagtagctgggaccacagttgtgtgccaccactcctggctaataaaaaaaactttttttagagatagggtctcaccgtgttgttcaggctggtcttgaactctgggctcaagtgatccccccacctcggcctcccaaagtgctgggattacaggtgtgagccaacatgtctggcccctctttttttttttttttgcgatggagtctcgctctttcacccaggctggagtgcaatggcgcagtctcggcgcgctacgacctctgcctcccaggttcaagctatccttgtgcctcagcctcccgtgtagccggaattaacaggtgtgtgccaccacgcctgcctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagacaagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgcgaagaaatagcacattctttaaaaaaaatgaatatttgatattgtttgttcctatgtggagaggatttcttaactctttcttcatctggctgctagagcctctagcctgaatatttagtcacttcctgaactaagtataattattgatttgccaaccatttaacaccagctgattctaaaaacactgctgtggggatataaagatgaagaagatacggatctgtcttaaagagctgagagcatagtgaggaagatagaagatatatacttaccttatattaggctcttggaatttgtggatttttttcccccgtttttggcttgggatgaatcctaaaggtctgttgcatattacctgtgattttgctaagatacaaactttaaggtagttagatggccattgaatcaagcagtgaactgaagaaacataatgcttcctataaggagcagttttgatataaaattggatgaattttgtaaagagcaagatgtaatattaaatcaaagttattataagctttggtgtatagttaggctgttggccaaagctcacattgctcttttattccatagcccactttttttgtgggagctaggctttcagtccttaaagtgactttctacttttttccttttctcttttccttctacccttgcagggctctcataagtgcctttgcatggtgtcacagttagatgaaaattgcctgtattttttttttatgtctttgatctgggcatcccgagggtgcctctgtaagtgtgctgagacacaactgtgtagtggtaaccaaacctaattgcccagcagaattaactcaaaggagggtttttaaaaaaagttgaattgaaatataattcatgtaccatacgcttcacccatttaaagtgtacagttcagtggcttttactatgttcatagagtattaccactgtcaccacagtcagttttagaagattttcatcactccatgaggaatttcttacctattagcagttactccccattttacccaaacctctcagccttggcaaccgctaatctgtctctgtaggtttgcctcttctttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgccttggcctcccaaagtgctgggattacaggcgtgagccaccgcgcccggccggtttgcctcttctgaacatttcacataaatggaatcatgtagtatgtggtcttttgtgactggcttctttcatttagcaaggttttcaaggttcatctgtgttatagcatgtatcagtattttatccgaggactatgattttttgattgcttactgtaaacctatggaataaaaatctctgggaacaaggcctggaaataattctttttttttttttcctgagacagtcttactctgtcgcccaggctggagtgcagtggcgtgatctcggctcactgcaagctccgcctcccgggttcacgccattctcctccctcagcctccccagtagctgggactacaggcgcccgccaccagggccggctaattttttttttttttttttttgtatttttagtagagacggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagcttgtccctgttctcctatggccacttaaatccagaccttttcatctaaaatgcaaatatgtttggcatttttcatacacattcctgtcttttttcccccttctgctgtcttatgtagatactgagaatattaaacctgtactcttttcatttgctacataagcacccgttttgttgtccagctgtattttttgggttggagggttaggtctgcaataatcatgttatttcccctttgggtatacaaatgagacaacgtgagcaaatacaatctgtatttttaaagtgatggaaataacttaaatttttttttcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtaagttatatgtttcagaggaaatggtctccgtcttaattattataaattgcccataatcttattacccagaaataacgacttaatattttcctgtattccttttgtgtgtgggttgggctggggggagtttgaatgtggtgctgtaggggtggcatgtattttttgttgttgttgttgtttttgagaccaagttttgctcttgtcgcccatgctggagtgcagtggtgcgatctcggctcactgtaacctctgcctcccgggttcaagtaattctactgcctcagtctcccaagtagcgggattacaaatgcccaccaccacgcccggctaattttttgtatttttagtagagacggggtttcatcatgttggtcaggctggtctcaaactcctgacctcaggtgatccacctgccttggcctcccaaagtgctgggattacaggagtgagccaccgcgaccagccttgttgtattttgagacagggtctcgctgtgtcacctgggctggagtgtagtggcgtgatcgtaggtcactgctgccttgaacttctgggctcaagggattctcttgcctcagcctcctgagtagctggtaccataggcacatgccactcggcccagataattttttttttaattggtagagacagggtctccctttgttgcccaggctagtctccaactcctaggctcaagtgatcctcctgcctaagccccgcaaagtgttgggattaggcctggcacagtggctcatatctgtaatcccagcactttgggaggccgaggcgggcagatcacctgagatcaggagttcgagaccatcctggccaacatggtgaaaccccatctctactaaaaatacaaaaattatccgggggtggtggcatgtgcctgtagtccctactcaggaggctgaggcaggagaatcgctccaacccgggaggtggaggttgcagtgagccaagatcacactgctgcactacagcctgggcgacagagcgagacttcgtctcaaaaacaaaagtgttggaattataggcatgagccactgcatctgaccatatttttcatctaaatggttgtttatgtatgatttatcttgcttccttcatgaattctctcccatagtctctgtattaaaactataaatatcacttttattggcaatataatcttttttatgaagtagtcataatttgcttgcaactttctgttattgggcatccaagttttctcaacttttccactgttaataatcatactctgataaaaacttcaacaaaaagtgtcttcattgcaagttatttccatagagatacctaaaaacagaattactgagacaaaggacatgaacatctttaagtcttgcaaattgccaaaatgacagaaagattatacctcttcatgcttccagaagcgcataaccttttcttttcttttcttttcttttttttgagacagagtctcgctccgtcacccaggctggagcgcagtggtgcaatctcggctcactgcaacttccgcctgccaggttcaagcaattgtcttgcctcagcctcccaagtagctgggactataggcatgtgacaccatgctcggctaattttttgtatttttagtagagacggagtttcaccatgctggccaggctggtctcgaactcctgactgcacataaccttttcaatattgactttcttgtagaaaaacagatttctttactgtaccgatggattaatatagtggtgttccattgctttaatgacttaaaggaaaacccattgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattccctccagctttgatatagaaaagcagttatataattaagatatatataatgtgaattgtttatgttggcaaaactaatggcacaaagaaaaatttcaaacccttaagccaatttttttattttatttcaggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtaagcaaagattttaacaaattaaatattctgaattttgtttaatttttttttctaacttaacttttccttaaataaaacaggtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctaaatatttaaggtttgttttgtgtcaccattaggtgaagatggtcagccttttgaacaaactgacactacagaagaggcaggtttcagctatctaaaaatggcaactgttaaaaagtagttgggattgctacattagggtggtatcattagaagtgtttaaaagttgagtgtagaggccgggtgcggtggctcacatctgtaatcccagcacgttaggaggccgaggcgggcagatcacaagatcaggagatcgagatcattcctggctaacacggtgaaaccccgtctctactaaaaatacaaaaaaaaactctactaaaactacaaaattagccagacatggtggcaggtgcctgtaatcccagctacttgggaagctgaggcaggagaattgcttgaacctgcacggcagaggttgcagtgagttcactggtattaaggtggtttagttattacagtatttggaagttgaacaaatgactattgaggtaccatttggttttgacttgaaattttagccagttcttacaacctgtaaatgaactttagatctaatcatgcgtgttccttaaagttgtgtgcttttaactttcttttttagggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggtaacagagttcctttatgaatttattggagatgggaatttccagtttataaacaaagacgtggagctataaactgcttaaattaattgccttgttatttaacggtaatcttgttttctaaattcactagctctcacagataagatatgacagagaagagtaatgagatgtttgtctcttaagatcatataaaatctttggaaaatcatttgggttttatattctgagtataaacaatttgactaaaaactattctgtgtgtttaggcatcagaaattgttgagtatgaagaagatgcacacataacttttgctatattggatgcagtacatggaaatatagaagatgctgtgactgcttttgaatctataaaaagtgttgtttcttattggaatcttgcactggtaagtagatgcagtacttgagctaaaagttttatttatttatttattatttcttttaaaagacggggtttctctgttggccaggctagagtgcagtggcacaatcttggctcactgcaacctctgcttcccaggctcaagcgattcttgtgcctcagctcccgagtagctgggattacaggcatgagccaccatgcgtggccaagctgaaagttttttgttttaaaaagctaatgatttcataaaagcactatttgtatagatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcagtgtttttgcgttggtcttatattttggtaatttcaaaaatactcagtaatatgttgttattaatgcacagaagggatgtgtgtgtctaaatgcttatatttgcttgctttgtcttaggtttggtgtgtctttttaaacttgggaatctaggtgttatcttagcagtgtaatcaaaacaaatattataacctcaggactaattcttaatgaactttgctgaaattgaaagttgttgctgacaacttaagagcatttcttctcatcctcatcagccattatgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatagaataaagacaaaaaaataaaaataataatacaaaacagcagaaaaacaaagaaaaaagataattaaaaaacactttcacgtgtattattatttaaagtgtaaagtgcttattaaaatgacaaaaatgtaaataagataaaatatatcattttagagtttttacttttggaattttttgcaaatgaaagcccttaattaatgtcttttatttttagttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacggtaagtcacttaatttctctagctgtactttttattccaagattccttccctggccactctctcactttttttctgaagctggtcagaatgtccccttgccatccaaatagtatggcaaggggacattttggtctttttttttttttttttttaaggcagggtcttgttgtgcaggctgcagtacagtggtatgatcacagcttactgtggcttcgacctcctagctcaagagagcctcttggcttagcctgccacgaagccaggactacagagagtcacacgccactaggcccagctaattgtattttttgtagagatgggatttttccatgttgcccagggtggccttgaactcctggctcaaacaatcctcctgcttcagcctcccaaagtgctgggattgcaggtgtgagccactgtgcccagcctacataccttggtcttgaccctttaccatattttgttttgttttgttttgagatggagtctcactctgttgcccagtctggagtgcaatggtgcgatcttggctcactgcaacctccacctcccaggttcaagcgactctcctgcctcagcctcctgagtagctgggattacaggcacccgccaccaggaccagctaatttttgtatttttagtagacacagagtttcaccatgttggccaggctggttttgaacttctgacctcaggcgatctgcccaccttggcctcccaaagtgctgggattacaggtgtaaaccaccacacccagccctttactatatttttgaaagtactttatgtgtctctctcctcatcttccacaaaatttgagaccttcaaaggtagaaactgttttatttaaaatataagagttcctgacacagagaaggttcccgagtgattgaactgctacagtgtactaatcatactctggtctatgagttcattctcagattagctgtggattacatgtgtttcaaatgtatagctaggaattgaaaagtggtctgagcttcaaaaagtcttgctatattttaatacttccatatgaatttgacttaattatgtaaggaaatagttatgtatatatatcttattttaacaatagggttcaaaggagcttgacttttttggaattggaaataaaagtaggttctttcatgtttatcaggcaagaactaaattatactgctaaagttacatcaaggatatgctgatgtgtggcgattattacagtgtgatcagcagtatttgcaaattgagagaatactatttggtggggaagacatttttgaatttgcacaaaaatcttgaatgttaattctgtgtagtcatggcctatgacaattacatacaattttgacttaacatacaggtttcaggctcccaacattgtattctgtggaagtatagtggagcactagtccatgagcttgaaaagcttggtactagtactgactctgccattaattaatgatcttgggccagtcacttccttcgtgactggcttcttatctttaaaatgagagaattattgaagccagttctcattacactgaatgttaaaaattacagttacagcagtgattgcaaattcaaagctctggtgcggataccaacagtgaccataaagttttctaggtgattccactagtttcttatttcttggatgtgtatgtgtagcatctggactaggcactgtagatggatgagtgggggaaattttatttagcttgaaaattgagatagttttggacctcatggttaggtctttctgggaaatttttatttgaaacacttgtagaaaaagaaagcagacatgctagatctgtccctgacctcacttgttagaactggtcggattcctgggctgatacagagaagtttgaaacttttcaaaatttacctgttttctgataccactacaatttctttggaaaaagaatttcctgttaagtgtctgttttgtaaggggacattttgtaggttctagggttgggtatggtgctgtcatttagttttcttcagcagagatcaggtagccacatagctacactagatggcattgtatctatctgccatcttgtcaaggcagcagagttgtgttaagagaacatttttggagtcagatgtggttcaaattccagctgttattccctgcatccctttctctcattttaagataggagctaatattgtttacctaacagtgtagatagtataaaaattaagagtttaagtgcattggacgtattattatatacataataaattatctgcagctactgcttttttccctttcctggtggagcatttgaacgtcacctggagaattagttgtattttgtttcagcatggggttaagtgaaaagctaatttggggaggtgatttggaatgtcaggtagtccagattgcagtatagaaagaacacactgaaaggatggtcagtgtaatgttagaggactgtgaaagttggggaaagaagtttagtttgtaggtacttgtttttttgagcagggaattgtcttggctggaggtgaatgtcagaaaggttaatgtaggcaagtgtagaatggaaatgaaggtgtgatcatttaggaggttatttgtttaggtgagagagttaatgaattaggttttgtattaacgaatgaaaatgggagcagataaatttttaacaaattaagaatcatattttaaaatcagcaccaggtacctagaactcattggcaaatagaaactttcaaaagatataatcaggtccgggcgtggtgggtcacacctataatcccagcactttgggaggctgaggtgttggatcacttgaggtcaggagttcaagactagcctggcaaacatggtgaaaccccatctctactattatacaaaaaattagccgggtgtgctggctgacgcctgtaatcccagctactcgggaggctgaggtgggagaattgcttgagcccaggaggtggaggttgcggtgagccaagattgtgccattgcactccagcctggatgacagatcgagacaccatctcaaaaaagaaaaaaagaaaaaatcagttatttaaatttaaaagagtaagtttccccagcactgtttctggcatgatataattaaatgattaaaattatttgatttttttttcttccaatagaaactaaatagcagtaagtcagcatcccgtcatcgttggcccacagagaattatggaccagactcggtgcctgatggatatcaggggtcacagacatttcatggggctccactaacaggtgagctggcaagtgcataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttattgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatacagggtttttaagttctgctctatcacttactataatagctgtgtaagttaacctgtctgaaatgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaatttgatttaattacagtaacttagaatggccggtaccattattaatcccttttttataaataaggaaatggataaagaaaggttaggtaacttactcattattatacagctagttattgatagagccgagattcacactccagtggtgtaactccaaagcacttgccagtataatacattgctcccaggcagccagaaataaaaaaattgttccttttacgtacgacagacttctgaaatggtagtagtagtgcccttttttttttctctttttagcccaggaaagatttagaataaaatctagtttagatgagcacatttgtgtgatggttcctatagttaaggcaaccccactagccttttgtgatagtatcttctcaacacaagcaaaataacagaaaatctttgtgaagtcaagcttattaaatgtcgtaagtcatagataagtatatgaaatgtctaacgttcaaaccttgttttcttaaaaccttacacatcatataggtccttgtaagaggataaacaaaccggctagcctttcctggggcttttttagtgacgtgtgcagtcagttatttggtgccttgtgggtcatgatttccatttcttctgtgtacaggcataaaaggtcttctgttcttatacaagcatgtaaatccaacattctcattgtctcattttattcttgcaatgaccctgtgaaatgtgtagaagcagcatatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaagatggtccttgtttttttaaaataagatgattaaaattaaagattaatgagctcataggagatactcagaagtactgaacagggtgaagaaaactaaaaactaaccaccttattaacatttcttatatttgagagcatttccttctggttctttctctatacatatagtattttttatgagattgttaccatgttactatgttgtgtgtagatgagctagcctgttttttaaatgttactttagttctgagcatttttaaacttaaatgttttttgaatattaatgagttcatggtgtcccatcacatggaagtactgtaaattctgttcctttatttatgttgtttctggtttatgccattacaaattctaggacactgtcctagttttgtagggtattcaaaatattcagtttatgctcttaccactagtatctgatagtgccattttcgcacttttgctaatgctgacttactagtttataaaatcctttgccaatttgtaggaacaaaagttatatcaatttttaagtttttttaatactagtcatgctcaacaattcatgcaaatggcagttggtagttttgccatcttcaacgtgggtaccttccagttgtttggtttcttggtaaaactcacacaaaacagatggagaagagtttttgtatatcaacatgaatgttaatgtgatttttttaaagccaacgaacacatttgtgttccttgtgagatcctgtgcatgaatttgtcaggtaatttttttgacttgaacattctcataatagcttcaatttgcacaatgcaaccttgtcattttgcagattttcaaggctcacttcaaaaacatgttccttgaggcctattaacatttctttcctaaattgtctattcatatggtgctttaaaaaattagattacttttagtatatttattagagcctcacagtttagagtcagtagtcaattaaagtccctacttaaacttcagactaagattttttttttatttaatattttattttttctttttgctttcatgcagacagacattttgcaagactttaagattcttgggccatttctgtcaggttgttctgtgttctgtgcctgcttcctccccatagtaatttcaaaatagttatcctcacctctgtaaggtttccaaaatcaaacttgggcttctggctagccttttctaggtcttgatttttcagtgctttccagaggcaattgtttggaacctcttcgcacagtttctgtttcttcttccatgtacaggcataaaaggtcttttggttgttttctggtaaaactatcataaaacagttcaagcaaatgactattggtagttttgtcattaacatgggtgccttctagtcgttttgtttcctggtaaaacagaccaaacagagggagcagacagtttgtacatctgtatgagtgttgatgtgctttttattttaagccagggaacacattttatgttatttatgacatcctttccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttctcctttattccttttttaatgcttgtgaggtagttcttgttgatcacagcgatgctattctcttattcttcatgtcatatttagcaatttttttctagtttgtcatttgataatcttgattggtatattttgatgtacagaaatttaaaatttatgtagttaaatctttctttaatttctattgcttttgtatttatagctcttgcctagatagtcttaactgtagtatagactttaacagtgttttctttcttttcttttttttttttttagttgcaactactggcccttcagtatattatagtcagtcaccagcatataattcccagtatcttctcagaccagcagctaatgttactcccacaaaggtaacaaaggaataatttatacatttataattattttctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgttcttctgcttattttgaccacaggcaagtttcttaacctctcaatgcatcagttgcctcatatgtgaaatgagggtaataataataccttaattcatagggtttttgaggatattaaaatgagataataatgtaaagtgcttagaacagtgcccagctgacacattaataaatgctcaataaatgttatcatcatcatcatcatcattattgttaacatcatttgataaattgtttaggaatgaagaaggtatttatttcatgactattttgggcatgtggatcaagaaaattcaccttcatttatgtttcagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaaagaacttggtacagtgtatggactcatgcttgaatcatgcgcattaacgtgagtctttttttaaagtgttcattttcatttgttctgtttcttttgtcactcagaaaacatgatattgaggctgggcacggtggctcactcctagaatgccagcactttgggaggttgaggtgggcagatcacttgagctcaggagttcgagaccagcctggccaacgtggtgaaaccctgtttctactgaaaatacaaaaatgagccgggcgtggtggtgcgtgcctataattagcagctactcaggaggttgaggcaggtggatcgcttgagcacaggagatggaggtagcagtgagctgaagtcatgccactgcactccagcctgactgagtgagactttgtctccaaaaaaaaaaaaaaaaaacaaaaaaacaaaaaaaaccatgatattgagatgttctcattttatgtgttgtatgtcagtcttgctcatgtattaaatgagcaaagaatgaaactacagggataaatgaatatgtaagacagtcagattggtggtataaattgagggattctggctttttatgttttaaaagcatattcattttgtttcctaaaatgttaaaaaatgaaatattctttattttctaggatttaattttagcctttttaaatctaatcccatggccttttggactagcaccccttcctcacagcctgagagcaaaggtatagaactagcattctcagtatgagataacagcagtttttagcagctggtagcccttaggaaagtattaataactgtggctgtatgaaatgaagtacttaccactacaacatgaatgttaaagaatgccagtttaagcaaagtaccttttgactggtggcatgacacccttgttggtttgttttttaaaatgtactgggatgctgatttgtaatgtacttcattgctctgctatttcaggtctgctcagtgaagacctatgttttatctaatgtttatctttagccactaacgtctgccagtattcacatgtagtggcaacggcatgtatacagtatggaagagtgtccctgtagggctgttcttttgtgcatggtttagaaaaatgttgtatttgaaaatggaccccatttttaacagccagcattctacagcttgcatattatatatgttgcacagatcatttttagaagtgtggctactagagtggaacaagaagtgggatctgttgaaggccttcaagaacaggttagggaagtgaaacctcacccttagtgaccagtaacacatcttagccatgccaaacaagtacaatgataaaataacaatctctgatttttttttgagtataccagttttattaccagctaaggtagctcttaatcttttattttaaagatacggtctttgagaaatgtgaaaagtgttaacttaaaagtggatgtatacttgcgtacagtttctgtgagctctaggttaggaatccctgacctaagaacgaatgtgcctatacactactgtagaacatagagccttattctgttttgaatctgataatgtcattgtcccaagggaccttagaaatgaagactttagacatgagtaaactgaggccaagagaggctatctgatttacccaagaggtctttactgagtaatagcagaagtggaacaagaatctgtatcttacggtgtactgttatttctcctagctaggaaatgatactaggttttcgtttataatgaaggagagggacaaatttaacattgtaaaaggaagggcactggttctgcagagcagtgtcatccaatagaaataaaatataacctgtgtatgtaatttaaaattgtcatttggtgcaatggcttgtgcctataatcccagttacttgggaggctgaggcagagggatcacttgagcccacaagttccaggcttcagtgaactatgatcacatcactgcactccagctctgggtgacaaagcaagaccgcatctcaaataaatacataaataaataaattttctagtagccatattaaaaagaataaaaagaaacagttaaaaagggaaacagatgaaagtaactttatcgatagatttgatttaactcattatgtccaaaatatcattttaacttctaattaatataaaaattaatgatattttacattattgtttttcaccaagtcttcaaaatccagtgtgtgtgtttacacttactgttagcatgtcttgatttggactagccaccttgtgaggttttaatagaatgtggctaggctaccatattggacaccatagctctcagaatgtttccctgtcaccagttggtatacatggcatgcttcataactggcttactttattaaactcctttagccagaagttgttctttacattaatagatcagaacaggttgcatatagaagttttttctgtttctaattttttgccctttgcattgatggtggctggggatgggttgttttcagccatatgaatggtcttagattttatagtgttagctacccatagagtaacagtttttatttaattttatctagtatcatgcttgaacacaggcaaactagatgcaactctagtcaccttccattcttggcaattgttaactttccttacaggaactaatcacagttggctttggattagtttcatatgtatactaatacttgcttatgttttaagatttttttcaattgctgcaaatgcatggatattttggtaaactattgtatgctaagtatagttaggcaacactttaaaatttttaacctttttaaattctagaaatttgtagtaattcttttcaatgactattaagtaaacacaagatttttttgttttctttcgttttaaatagattctgtgttcacttagggtttttggtagaaaactaaatcaggatgctaattctaattcatgattatcgtacatctctgcatcaaagtatatgtgttttttatcagtatgctgttttaacctatagataggttccatggtttttattttcaggtagagtattaacgtcaatacttaataccttatctttgtcaatttttttgactggtgttacagcaaaagagaagaaaaaacctgaagattctccctcagatagtctcggtctcctgacctcgtgatccacccgcctcggcctcccaaagtgctgggattacaggcatgagccactgcgcctggctgacacatgtcttaattctggtattcaccagatttgtttcgtgttctccgttgttagtcatcaaatttgtctactttttaaatagaaacattagctagagcaaggaacttagaaacactcaagcagcactgaatgtgtagaattgcataaccaatatagcttctttgctttcatatttacaattagttggagttttagttcagccgtacccagtatcttccattctgcttccaggaagaaatggaaaaatgtcagccatgatgatgcagtattttagtagcaagttgatggtgttttggtttcccatgggaaatattgtcactggagcattagcagctatcggtcacttattagggtaaaaaagcaacttcagaagaatttaacatatgccaaagaatcaacaaaggaagtaatcagccagggcaaaggtcgcacaagagattgtaatctagcaatcagcagtggaataagcagtcagcttaccagaaacccaggaaaatgctttagaaagggcagtcaggactaaggcaatttaatgaaatgcaaaataaatgaaatctgaagtttaaaaatctagattacaattctggtttctaactcagttatgagaccttgggcaaagtcattaaatttctctgaacttcagatttttgggagtcaataaaccaatacatgtcaaagggcccgataaactttacagtttagaccaggcgtggtgtctcacccctgcaatctcagcactttgggaggccaaggcgggtggatcacatgaggccaggagtttgagaccagtctgaacaacatggtgaaatcccatctctattaaaagtacaaaaattatctgggcgggatggcatgcacctggaagtcccagctacttgtggggctgaggtgggaggatggcttgagcctgggaggcagaggttgctgtgagccaagatcgtgccactgcactccaacctgtgtgacagagtgagaccctgtttcagaaaaaatatagtttatcagcaaacaggaaagtcttgctaggcaacgtaattgattagttctgtgccctggattctgggctcttaactgtatgagcactgtaggtgtgagcagcaacaattaagaagctgcagaggtaaaggtataagggcagtgattgaggatgtctaccaagcagatttcggcaagtgtgtttcaagaagtatgccgcaatctgaaatacctaatcctgaaaaattgctagaatctagtcttttaattttggccagtatttagcagtagtttggccctctactctaaattaataaaaaataagtagtactatattatgagctgtgttatctaacagtttatcttagctagtagcaattaatttatagctgctattaaaatgactaacgtagttaaaagtttgatgactaagtttttttttgtttgtttgtttgtttttttgagctggagtctcgctctgtcgccaggctggagtgcagtggcatgatcttggctcactgcaacctccgcctcctggcttccagcaattctctgcctcagcctccccagcagctgggattacaggcacctgccaccgtgcctggctaatttttgtatttttagtagagatagggtttcaccatcttggccaggctggtcttgaacttgctgacctcgtgatccacccaccttagcctcccaaactgctaggattacagatttgagccaccacgcctggccttgatgactaaattttaggaaatgttttagcaattcttcatacacctttcacttatagttacttaattcctctactcttatcatttgatattttcattttattgtgtatctctgtaaggccgaatcaatagattttgaacaatctcacacttaacctttaaaaaaaatctaataggcccagtttcctctcagcaatctttgaagaaccttcgagaaaggagaaacacagacctcccgcttctagacatgcacactgtaacccgggaagagggagaaggcatggagacaactgattacggagtctgtgtcttccgccagcacatacacacagtctttagagcagctgcttaattctcccgaaactaaacttggtctgttactctgtctaaatatgttcttcttctttaatttcactgtcttatttaattactattacactaaggtacatatgcttttttgggctgctccaataaaatttctttcaatattccactacctgtttgtattagggttctctagagggacagagctaattggatggttggatggatggatgagatggatggatggatgcttattaagtattaccttacacgatcactaggccatctgcagactgaggagcaacgagagccagtccaagttccaaaactgaagaactaggagtctgatgttcaagggcaggaagcatccagcacaggagaaagatgtaggttgggaggctaggccagtctcgccttttcaggtttttctgcctgctttatattcgctggcagctgattagatggcacctaccaggttaagggtgggtctgccttccccagcccactgactcaaatgttaatctcctttggcaacaccctcacagacaacactcaggattaatactttgcatcctttaatccaatcaagttgacacccagtattaaccatcacactgtccaaatggaaaaattattaaacaaatcttttttaaaataaaatgctagctcttgccctaggcttgaaccataaataagtggtgggaagtttatagtcacaaataggtggtgggtattagaaagcaggataaactatcctctcacccttccaagaaactgacagtttcagtttattcctcttgatgaagtaatgctaaatttttgtagtgatgttttggtatattttattacctgtaattaatattactgttcaaaatttagggggaatctgtcatcttcctgaaacttcagaatcacctggagtaagggtcatttgtattcatggtcactgaccacatggggtagaaactgcaagtcatggttccttcaggcaaagttaatagtggtgacacggaggcatcatgatagagcagcagactccagaagccaatttgactttgtgatttctgaaaaaattacctgtcaactgtgagcctgtttcattgtctgtaaagtttgaataatgatacctaccccgcctgatagaagattcttatgagggaacatgatacgtgaccagtaaatgttaatgctttccttatacgtgaaatgacataaaatcttggaatattaatagatgggaagaagatgtgtaataaaactgtctataaacacaattctgacaaatttcagaactgggactcatagggcttgtattcagttagattacatgctttacaacagagatactgttttatttgtgtcacctacaacatataatctgttgattgaggtatgttgaatagatgaatggcaaagaaagcagacctataaaatatcacatagtaagatatttatatttagatttttcttatttagaatcttcatctgtaatgtatgattttgaaaattaattcttggaacaacatgttgcagagcctccattatggcatgctgaatttaccaaagaagaattggttcagaagctcagttccaccacaaaaagtgcagatcagttaaacggcctgcttcgggaaacagaggcaaccagtgcagtccttatggagcaaattaaggtgagatcagaaacctggccactgtgaaaaccgccagtttggttttctggaccctccatacacatgcacccaagtttaaaaattcacattgcagatgcatctataacgtcttgatctttatattagattattagattcctgatggtgagaaataaatattgccttttttttttttttttttttttttttttgagacagtcttgctctgtcacccaggctggagtgcagtggcacgatctcggctcactgcaagctccacctcccaggttcacgccattctcctgcctcagcctcccgagtagctgggactacaggtgcccgccaacatgcctggctaatttctttgtatttttagtagagacagggtttaccatgttagccaggatggtctcgatctcctgacctcgtgatccacctgccttggcctcccaaagtgtgggtattacaggcaagagccaccgcatccagccaaaatacttcttttacacctattacataaagattatttcttaattcctacttttcctaagaaaccgtaatagatttagaaactagagagatgttcacaaatcattgttcacatatgcttaaataaaaaatgggtgtgagtctttgaattctaaagataaccagtgaatttaaattattcaactgatatttatagtactgaactactaaacagttttcaggtggagatggcaaagtggcatgggaagtttttcctgtttaaagtagacaccagaaacatctaggaatgttgcagaacagttgaggattactcaaatgaggtatttccaccctggctcactgataaatcacccctcagaatatagtcatactgcttattgaggagttcttatgacccaggccctgggctctacatacattatttaatctcatcactggttgagagaaaaattgaagctggtaaatggtggaacaaaattcaaactcatagctgtctgaaaagtacatgcttttcccctgtactttgctgttcctagtagatctgtcctgccactgtgcaaggccactagctatccttgtcagattattttaaagccgaattcagttattttcagtaaattgtatatatcatgacattccaccattaaatacttcagtatgcatctctataaaatagcattttcccactaataaaaacattatcatagctaacaaatcactaactagcccagtaaacctaaatgacttatttaaatgttatattttcttttttttttttttttgagatagtcttgctctgtcaccaggtttggagtgcagtggtgcaatctcagctcactgcaatctccgcctcccaggttcaagcgattcccctgcctcagcctcccgagtagctgggactgcaggcacgcaccaccatgcccggctaattttttttattttactagagacacggtttcaccatgttggccaggacggtctgaatctcctgacctcatgatctgcctgcctcagcctcccaaagtgttgggattacaggcatgagccaccacgcctggccaaatgttatattttcataaatttatactctcttcatgatttctttgtcttctttattgtcacttttttaaatggtcctaggtttgaggacaaagttcgctaactttcttgcctaacctaaaatgaaaatatactaaaagctatggcttggtttcaacctggaaatcttcctcaaagacttgaacatgatactaccttttttatatcgttctttgcctcatttctctgatagtgttttacattgtcttatattcctgaattttcactgtgtctgaactttttaagtgccgttcactgtggacgtcttaactgcctgggacttcaggaacagcgtaggggcagggggttagtggaggctaccgatgttcccctcagcccattttcagagccccatgccatactggcttagtttctatcaaaagtagaaggcagagggaacatcttggtaccaacccatggctccagttagttgctcctcatggagacgttccatcagttccccagctttcaactccatttccatgataccctgtgcttctgagacaagaactccagtatttacacaggatgcatcctctcctcttgtcagtgatacttggtaagctgctggactgactcatttccacctcttcatctgtttctcgtgagaatgtcttgacgttatctcatctactttttctcctcttgtattagcttgttgcttttctacttcacccctcttccttccaaccccaaatagcttaggacaatggagtcatatagcccaacacttggttcatatgcagcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacattcagcaaaatacaataagtgcttagcttgatcttctagctctttgaaaattggatttttatcctggtgttgagttctggtgttcagctgaacgtggttttgttttaaattctactttttaaaaaacatttattagcttgttccttttctacttcacccctcttccttcctccaaccccaaatagcctaagacaatggagtcatatagcccaacacttggtctatatacagcagtccactttctaggcaaatgcagttttaaaactgtgccataggccaggcactggtggttcatgcctataatcccaccactttgggaggccgaggcaggcggatcacaagatcaagatactgagactatcctggccaacatggtgaaatctcgtctctactaaaaatacaaaaattagctggacgtggtggcatgtgcctgtagtcccagctactcaggaggctgaggcaggagagtcgcttgaactcacgaggtggaggttgcagtgatctgtcacgccactgtactccagcctgacggcagagcgagactcccatctcaaaaaaaaaaaaaaaaaaaaaaaaaaaaaaaaaaaaaaaaaaaaaaaaaaaaactatgatgtagttagagttggtttccatgtcagatggatttaatactgtgatgtcattaacttctttgaaatgcttcatatacaactgctatagttaactgaattcaagctgcatcttaagaattatggtttcatttttgttttagttttaaattacttttatttttgacatttacaagcacaaggaagacgctataatctctcttgagttgtcacccatctctaacggttttcaactcatggacaatcttttggcgtaaataggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatgttccttaagctttattttgttgttgtgtttttgtttgtttgagacgtagtgttgctctgtcaccctggctggagtgcagtggtccgatcatggctcactgcaacctccgcctcccggattcaagcgattctcctgcgtcagcctcccaagtagctgggactacagatgcacgccagctaatttttctatttttagtagagacgaggtttcaccatgttggccaggatggtctcaatctcctgaccttgtcatctgcccgccttggcctcccaaagtgctgggattacaggtgtgagccaccacgcccggccattttgttttttttatctataacaattacatatataaatatatttttaatgtgccacttattaattgaagaaagtggtcatttatgctatagcagtcctatatttggtttttaatcattacagggtaacactgagcttgttctaattgcctataaataggaagatccaggtgcaattgggtgggatggtggacaaaaatacaccatagatggtattgtgtgctttctaagacatcaggaggcccagaatgtccagacatcttacttttgactgattgaccttatctagttggtgctctttaacatgttccccatcccctgtaaatcctaataactaaactgataagagtcatcctcaaaattgagcaggcatctgaatcatctggtatacttactaaaattccaattgctggtccccaatttctgacccaagattctgcatttttagcaattcgttgctgatacttctggtctggggcccataccttgagaatccctggtctagaggcctgataagattcaggcttaattttttttacagacatacttcataagtagtattgatagtttctttgaatctggtttttaataatctttctaatgatgaaggaggaatgttctcaatactgacagtaatctcagttcttcaaactataggataggtttctatagccacaatagtatttttgtcacaagggcccaaataagaatacatcatgtatatttttagtagttattcaaattacaggttcactgtctttaatttattctaacaaaagtaaacctaattttatagttataaaaaagaagaaatctacttctagtcacctaagagtaaaactgcccctataaaaaacaagacagaaatctcaaaattataactaattttatagttataaaattaaccaggactttaagaatgtttgcattttaaaattaaagttttcaatacaacaatgatattatctcaaaatactcagcatgtctaacaggtctcttttaaaagctcagcatgtttaatgtagacgttgctaacgtccaggtggctcctataagttaagggtccattgatttagaagttctaaaagagactaacctaagggataccaagaacagatatttttaaagaatttcatagaggagatacacattagaaacccagaactctaagatgtgcatttggtaagtcctgtaaacagacaggaaaacacatttaaattagtttgccctttaaagattatttcctacttgtctcttatcaatgtgagtacataaaagagaccttattacaattaaaaactgatggtttagcagcagatttagataccttacattttctctttaagagagagaatgtaaggcctggcacggtggctcacacctgtaatccagcactttgggaggctgaggagggtagatcacctgaggtcaggagttcgagaccagcctggccaacatggtgaaaccccgtctctactcagaatacaaaaattagctgggcgtggtggtgcatgcctgtaatcccagctacttgggaggctgaggtaggagaactgcttgaacccaggaggcagaggttgcagtgagccaagatggtgccattgcactccagcccgagcaacaagagcaaaactcttatctcaaaaaaaaaaaaaaaaaaaaaaaaatgtaaactacaagatagttcaaaagaaattacacagaattcagcatgggagaaacaaaaaacaagagtgggaaaagacatcaaacatgtttttactaatcgaagttctaaaaggagagacaagaatacagcacagataatatatgaagagaatggctggaaatctttcagaactgttgaaggatatctatccacagattcaaaaacccaataaaatctcaagcaatattaaaaaaaaaagaagaaatctacttctagtcacataagagtaaaactgcccctaaaaaagacagagagaaatctcaaaagcagccagagaaagaagacacattgcctcacaatagacttctcaacagcattggtgtaatactatctcatgtactaaaagaaataactgccaaccttttatattttccaagatctcttctggaaaacaaaaactttaagaatctgccttcactgaaaattcttaatgatgtacttcaagcaaaaagaaaatttcctaggtaaaagttctaagatgccagaaagaaagacatgcaaaggaaacttaccaccatattacagatatggactgtcagtctgactggtcacactaggggcatttggttaccaaggccttgaaaataataaccaacactgcatacatgagggatgccagaagaaaggtctgagagccactcttcctggcactgaaggaaacagggcccatcagagcaaacaagtaccttttacctctctccttggaagcaaatgtttataatctctggttttgtgtaaagtttataacagtatttttcattcaggttgctacctattagtggatggtgaaattaatttggtggatcacattcagaatatttttttaaaatcaaaagaatacaagctggggtcagtgactcacagctgtaagcccaaaagtttgggaagaccaggcaggaggattgcttgagaacaggagttcagaatcagcgtgggcaacatggcgagaccctatgtctacaaaaattttaaaatataccagatctggtggcatgtgcccatagtcctagctactcgggaggctaaggcagcaggattctttgttataaggagtttgaggctgcagtcaaacttctggtcgaaatcctggtcatgccactgcatttcagcctgggcaacagagtaaaaccccatctttaaaaaaaaaattaagaaataaaaataatatgtgaaacattagaatatgttgaatctagtaaggataagcaattatttcttgaaactctacatatatacatgagtgttggtaaatacctgactgtatcatcagctctagatataaaatgtttatgatgttggctgtgagttaatgaggaatagttttcctttctgtgggtttgggtgtatttgggaaacattagctaagggggtaaagtaggttacccaactctgaaaagcagcatcaaaatctttataataaacacatactaggggcccaacttaaatttcaagcagatgtcatgagctgctcagagtagcatgttacaactctgcgttataaggtaaaatgacacattgcctcacaatagcctgccagatctgagaacacagcaaaatttttattttgtcaaaaatctcatattcagcttacaccattcatttcaggtgaacatacaacagtgcatttcagtttagggaaatgtttacagtcatctggttctctttattcctgggaacaaggttacctcacttggaacacataaccagtgccaagttgtccatccctaagcaatattgcttccttctactttctagaagttcttcagattgtggaagagaaacttttcagagttctttgccctcattccctcctccagaaattcatgcctttgtataatctcttccccctgagagccagtaggctaacctaatgagttatttttaaccagtagaatacagcaaaaatgatagattacaagagattgtggcttctatcttgctagcggactctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacacagcagattgtaaataacacgtagataaaaccagacagaacagaaaaataaaatggctttaaacctagaaagtttccccatgtaaaattttgaaaatgctactctgcctaaggtcaaaccgtcatacatatatacgtatgaaaacacagaaaggtgtctggaagggtaataccaaattaaatctttatccaagaggaatgaaaaccagtattcacacaaaaacctatgcacaaaccttgtgaatatattaaaaaccagtgacttatgcactttaaaaaggtgaattatgtggtatatgaattatatctccaaaacatttaattaaaaacctgtacacaattattcatagaaactttctttaaaattgctaaaaacgaggaagatctcagttatccttcaactggcaaatgaataaacaaactggtacagccatgcaattgaatactgctcagcaataaaaaagaatgcactgccagtacagcaacatggataattctcaaatgcattatgccagttgacagaggtcagactcaaaatactatgtacagtgtgattctacttatatgacactgaaaaaagcagtactataaggacagaaaacaggttagtggttgccaaggagtgggagaagcagccagggagaactttgaggaggtaaaaatgtgccaggccttggtcggtggtggtacataactgtgcatttgtcaagactcagtgctatacgctgaaaagggcaggttttactataagttgtacctcaataaacatgatttttaaatgattaaaactttggtttttgtttgttttggttcagttttaaggtttaccataaatctattggttttagattctaagttgtatataagcttctgttttaaaagaacttttttaaaaatcctcttatcatcaacaatatttagttgtgctggaaattttattttggaattgtttaatagagaaagacaataaataatgttcaagaacagacattgattcataacatcaaagtatattgtgagaagatggtatttcagaatagaggaagaatttcttatgtgctggtaagattgtagataatcatttctgcataattttcatagctggattgctttaataaagccacttaaaggttaagttctagattgcttcatgttgcttatcaatgttttaaagctaaaatagaaaattagctgttaagttggctcaaccggaaattcagtatatcctttaaaaagagaaatttagtaagcagtgtgtctaaagaatgacatatggttgggtacagtggctcgtgactgtaatcccaacactgtgaggctgaagtgggaggatcacttaagcccaggaatttgagaccagcctggaaaacagcccagcccagcccatgcctggctaatttttttttttttttttggattttagtagagacaaggtttcaccatgttgcccagctggtcttgaactcctgagtgcaggcaatccacccacctcaccctcccaaagtgctaggattacaggtatttggttttttgtttggttttcaagcaacctttctcaattttgctatgctcactctttcttcacatgttggtactggctagatacagattttgctttcctattggagactcttttgagagctggctattccctcttgctccttttcttttttctcttccctactttcaagtttcttgctctttttcttaccccataagttaccagaaattcatacccccttgagagggctttttctttgaacttcagtctttagtttcatcaacttttctaaggaaattgatctgttaatgaaagttggcttgcttgacttcagaatatctgtattattcaatgatgtgtttttctggttgctttgtttgagcatagtgtaaatatcacccattgcatagctatggcagtgacataaatctagcagcgtaagatcgagaaaagctagaagtcccaccacagattgtatttcagtgaaagggattcattttaactgcttataaaactaaagaaaacttataaacatggaaaacaattattaaacccaccatatgctcatactgatattaaatggtgtgccagattctagaaagagttaccttttggtaagagcactgcttgttaactatggttggttgctttagatgtctagtgtgtacacaaaagcatgaattttattccttataaccaaagtagaaacctactctgagcaatttgacaaaaggtttacattatttattttagtgtagtttaagattacagtaagatgcaattcccaaagagtgaaatataaggctgggcatggtggatcacgcctgtaatcctaacactttgggaggctgaggcaggtgcatcacctgagatcaggagttcgagaccagcctggccaacatgacgaaaccccatctctactaaaaatacaacaattagccagatgtggtggtgcccacctgtaatcccagctactagggaggctgaggcaggagaatcccttgaacctgggggggtggaggctggagtgagctgagatcatgccattgcactccagcctgggcacactctcaaaaaaaaaaaaagtgcaatataacttttcacaaaatatggaactgtggtagtctagaacaatgtctcaatatacctcctacacgaagtataatagtaaatatctgtatttggtggcataatatgctcttagtataaaccaaaaacacatgctgagcattggacattgtccaatgtttaattcatatgattcattctgagtttctgactgagatcattctttcagactgtgtatttctcctgggatccataaaatatgcagccctaacatgatttcatttttgtttcctttcctggaaaaggagaaatcattcagatcagctttcatattgccttatagacgatgacttcaaaatagttttaaagggactcctttgttctagaactgctctaacacagtagccactagccacatgtggctattgaaagattgaaatgtggttattccaaatcaggatgtacagtaaatataaaatacacaccagatttcaaaggcttacatgaaaaaagtaatgtgaaatatctcactagtagtttttatagtgattacatgttgaaattttaacattgtgaacatattagtttaaataaaatgtattgtgaaaattaatttcatgtttctatttacttttgataaaagtactactagaggctgggtgtggtggctcactcctgtaatcccagcactttgggaggctgaggtgggaggatcacgaggtcaggagaccgagaccatcctggctaacacggtgaaaccccgtctctactaaaaacacaaaaaattagccaggcgtgttggcaggcgcctgtagtcccagctactagggaggctgaggcaggagaatggcgcgaacccgggaggcggagcttgcagtgagctgagatcgtgccactgcactccagcctgggcttcagagcgagactccgtctcagaaaaaaaaacactactagcacatttttaaattacttgtagtgatctcatttgtaacacattacatttcaatcgtatactgcttttctaaagagtcactgctaagccctgaaattaactccaaatacctccctgggatacagtgccaaggaaggggcttccttgaacttcaacctctaaaagtaagcaagaattgagaaatatcttctgctttgaaaaatattcactccccaacgctaatacatcaattacatattatttgggggctaactaagctcctattttaaaatgtaaactgaagaaatcaggccagagtcattcccatcttagtgccaatcatataatcagataattagattgctctttccctaaagcctgtttagtttttttgtttgctggttttgttgttgttgggttttttaatttgtttttgttgttgttgttgttgttgttgttttgagatggatactcactgtgtcacccaggctagagtgcagcggcatgatctctgctcagtgcaacctccaactcctgggttcaagcgattctcctgcctcagcctcctgagtagctgggactgtaggtgcatgccaccacgcccgtctaatttttttgttttttggtttttttgtttgttttgagacagtctcgctgtttcccaggctggagtgcagtggcacgatctcggctcactgcaacctccacttccgaggttcaagcgattctcctgcctcagcctcccaagtagctgggactacaggtgcatggcattatgcctggctaattttttgtatttttagcagagatggggtttcgccatgttggcaaaactggtctcaaacttctggcctcaggtgatccagccgtctcagatcaaagtgctgggattacaggcatgagccaccactcacagctcgctaaggccttttgccaagacaaattagctcttagagaaccacaggattccttttgtaatgtattacaaactaaagtcttacctactcttgaagagtagaaaacatggaaaagttctatgttagcccttagaataattaaaaattcataagctctgaaataaagacaggtaataaaatcattgcgtatgacaaaacaaaagtttaaattggcgtttgtaaactctgcatgaaagccaggtttctcactactagaaaaaaagttataaataaaccaaggagaattccagaatgaatcctgtggtgccaaatatatgttaactacaaggaataacagtgaccttacactggaaacaccttaaccatgggccaaggttaaagatataacagcattctcacaccccttgcatagctacccccaatgttaacataactgttaacaaattatcaaaactaagaaattcgtcttggtatagtatcactaactaaactccagacctcagtcaggttttcccagtctttccttcagtgtccttcctctgtttcaggattcaatccatgatccttgacacttggtactttgtcagatgtcccgctgtatgggtttgtttgatgttttcccatgattagggatagacactgcaagactcagagctactttacaaagaagcctctagggagctccccagagaagacaggggagacaacacaaggacactagaggaaattttagcctctgacatccatgactatatagcaaagagtaaacaaagcctaactcctagccagagaaacacaaaatctcatactaaagccttatttaactcagttcgtttcacccagtacatcatatacagcctcaaacaaaaaattacaaagcatactaaaagacaagaaaccccacagtttgaagagacagagcaagcatcagaaccagactcagatatgaaagaaatatcggaagtatccaaccaggaatttaaaataactaagattaacatgctaggggctctaatgtaaaaatggcataacatgcaagaacagatgggtaatgtaagcaaagagataaaaacactaagaagaaataaagatgaaatactagaaataaaaaacaccataacagaaatgaagaatgcctttgatgggttcatcaaaagaatggatatggccaatgaaagaatcagtgagctcaaagagatgtcaatagatacttcaaaagctgacacacaatgagagaaaagaatgaaaaagaaaaaacagaacaagagtcaagaactgtgagacaattacaaaaggtggaacatggagactttttggaaataccagaaagagaagaaaaagagaaagaaagccaggcatggtggcttacgcctataatgccagcaatttgggaggccgaggcgggcagatcgcaaggtcaggagatcgagaccatcctggctaacacggtgaaaccctgtctctactaaaaatacaaaaaattagcggggcgtggtggcaggcgcctgtagtcccagctactcgggagactgaggcaggagaatggcatgaacctgggaggaggagcttgcagtgagctgagatcgtgccactgcactccagcctgggcaacagagcaagactctgtctcaaaaaaaaaaaaaaaaaagagaaagaaacagaagaaacatttgaagcaacagtgactgaaaattcccccaaattcatgatagataaagctatggtctgaatgtttgtgtctcctcaaaagttatattgaaacttaatcctcaatgtgatagtactgaggtggggcttttgggagtcaatcaggttacgagggctctaccctcaggacagagattagtgcacttatgaaagaagccccagggaattagctagcccctgacaccatgtgaggacaaagccagaatgtgtcatctatgaggaagcagggcctcaccagacactgctagtgccttggtcttggacatcacagcccctagaacggtgagaaataaatttctgttgtttataaactctccagtttatgatatttttgtcacagcagcccaaatgaactaaggtagacataaaggaacagatccaggaagctcaaaatacatcatttcaataatgatctttaaaactttgtttgaaattatactgatcattccgctgactgctgaatgacctggcaccgtctcagggttttagtctggagtttttgtttatgctcatggcctcacggagaacaatattcacctgaagtgacggcgcttctctttttatgttgttgagaagcatgattggctctttttttgcaaaattattcacaaacttaaactttgattcagaattattgaagtaacatggtgaggcagagtaatatgtgacttaaattttatggagtactaaggaaaacgggcagacttaatataaaagtggtgcattggtggtgcttaagggcaaataccgataacatggtgtacaaataaaggatcccgatgattcaaacaggtggaagtgatgggagaactgagttgtcacacagtaccatatccacactgtcacacaaatctcacctttatttattcccttttgcactaacgtagccagaaatgtgaaacgatgacagttttttcagtaggtattttttttttttagtttttatcattgacctttgaggtgcactattaaattgctcagtccattaaaataacggattgctgatttaaaaactggttccttgcttagcttcagcaaaacagcaaagtctaccacattaaatgtatattgtttatttgatttttattgactttgttgtcttattttaactacttaattgcaaatctgtcttggggttaacactgtgtaagagttttaagcataagaagtctgtacttagagtttagatgtagttttatatttgtacatgttgatgtaacattttaataataataattcaggtctgctgggcatggtggctcatgcctgtaatcccagcactttgggaggctgaggcgggcggctcacctgaggtcgagagttcaagaccagcctgaccaacatggagaaaccctgtctctactaaaaatgtaaaattagccaggcatggtggcacatgcatgtaattccagctacttgggaggctgaggtaggagaatcgcttgaacccggaggcggaggttgtggtgagctgagatcgcaccattgcactctagcctgggcaatgagagcaaaattctgtctcagaaaaaaaaaaaaaatcaggttaattctgggatctgagcaaagttttgctcctttccgagaggtgaacacgttacgcaattattaataatatccctgtgggaaggggctttacaacaaattattttacaggtgaagggcagaaatgaaaacattttctagagccactcctgcccttcacactcaggaatgtcgcagtagtcatctctctgttctggatcagtagtatagcaccagggcccctgcgcatcgttgtctggattcctccagtccctctgaggggtgtgtagcaggtgagaatctggggaggatggaagagaagcacttagactatattctaaaaatcagcttgctattagcaaggcagaaggagatgctctcgattcccatctgagattgtcatccaaatgcatttcagctgggtgctgcagcatttgtgtggtcagattttcaatttctctattgataggctgcttctggcacagtagctaatattaccattgctactgtgacagccaagtcttagacagagagccaaaatatttttattgcacagtcaggagaaatataaaggcctcaaaagcctgccatggtcttaattcattccaaacacctgcttttgtcagttgcccttttctctgtaaaaattttcgtagttaacaccattttgtccatgtgaactatgtgccaggaattccactaacatctttccacacattctctcttttagtcctaataaaaaaaaccatttgaggaaggtgttattatccctgttttacagatgagaagactgagtggcaacgtaaaacaaaacaaaacaaaacttgcctaagcataaatagctatgaagaagcagatcaagaagtcaaagttgatctgtctgattccaaagtcctggttttctctgaaatgcagcttgaattattggggatggaggagggatttaaacttattttcagttctagagatgagttgctgtatagagacaaccatttagatgacaatcacaagacttacagtctagaaaggcaggttttatttctggttcttctgtgaacctatttgggtaacccccaccccccaagacctcagttccctcatgaagatgagcctagactacctcataaaaatggcccagagtgtctccatggcccccgatagtctctgacttcgccatttggttgaatcagttttcattaactcacggggaatatttgatctgctcatctcatagggatatagcaaaggcaatttgttgagtgttgggggaatggataaaggtgagtaacactaagttcctatttgataagtgtcattactgagaacttaaggccacctaacaccaaactgggaaaagcacaaaaaaatgcactaaaataaataataggcaagttgtgacatttgaatttcacgtatcttcattttcatttttatattttatttactattttgctccacaatttgagtcaaacatgtgatgagagttctaacttgatatgtttacttcagtcccaaacatagtcatctttggtcttttctcagatttggcctaaaactcgtagtttcattgatttttttttttaactaggcattcttctatgttctaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttttaacccaatactacgtattatgattgccagtacatcttcattgggacatagtattacagtagacataagacactcatcaaagtgtaaactcaaggtactttgtgaaagggaggtctaggggtcaaggaagatttgcaaaggaggtgatgattgagctgacacctaggcgataagaaggagctggcacagcaggacaaaggtgaagagggtcccaggcaggagggcgtgtgcttggggtggtgaaggaacagaagtaaggccagaaactttgtagaaaagtttagcaagccaagcaaacagcagccgggggttacgtaaataatgccgggccctggcacatttgggaagtctttgggtcttattttaagggcactaggaagggctttaaacagggaagttatatttcttcgagatcaggtgtacagctacaagtagccccaaccagtggtgatagggtcttggactcggtgaaggcagtgtggctggtggcaagtggcagaagtaaacgtgatctaacactgactgttcctggcaaaaccctggcaggtaagttagcagcaggtcaatatcccacagcaactgtatgtacccaccggagtttatataaccttttgctcccttctgtcactttgaaaacaagcaaactaagccttcaaacttcacacttcaaactcaacctacagtcattcccatgttccttctggttaacaatttacaaatgacatatttaaatgttagcattttgtagagagaatcaggagaatcagggttttttgtttttgtttttaaatctggtacaattaggtcatcctatttagtttaccgtttgcttgctacttgtaagaactaataactttaccagataaagtttagatttcatctgtactttaatctcaagaattcgagataaatagtggtaaggaagaaagtacaatgcgtacagctaatgaaacccaggaagatgagtcaatgcatagaaataattccaacccaaataaatactatttaaaatgctacttggagttttgccgtgatactagacacaatatggcaaatcatcctcaagaatacaagaactaaggtgtttccagtcctctttaacacctgtgatgcaggatatttggagagctaaattgttattattaacagtcttaatacctggccaccaacacagtagaggaaacagtttttaaagtgtcatacatctcttcaaatattcatacgcttaatgaaacattcgcacatctaaaaaggcatgcaatttctattgaaatcctgtgtgcctcttattctaagcagtgggactattgacccacattttaaaataaactatagaaaaggaactgtaacttttacacatttttaaaagacaacatatcagaaatctgagaaaaatatagaccatgtcccccaaaatgtgaaaaatttaagagtaaaaaataagatttgtgtcccaatctaaatgtttctgaggattaaaacacctcagtatttctgttttacaaggcttcgtccagatgttagggcccaaggaccatggtcaccctgcagaataagaagccaagaccaaaaggaatgcttagacttcccatctccttgttaaatataaaataatattttaaaaatcttattttcagggtcatagaggtagaagtgattttgtaaatctaatcctttcattttttgaacaaaaaaaaattaaatctaggaggtgaagtaatatactcaagctgacatggttagttagtaatcaaatcctgtcctaactcagaattcaattttacaacaccatagcaccttcctcctctggtctcataaattaaagatagaatagagaaagaggaagagtgggaggatggggaggacagtaggaggaggaggaagaaaatgtactcactttacttttcaaataaaactgcatctctcatcctaatgattatggaggacttcctgttttcagccattatcacacattgttgctctttactgtgatattggaatgccctgcagaacgaagcaggaaatccaataagtatttttctttatttaaagaaaacaaatgtttattaataaatgagaaatgctaaagatcattgactatcttgagggaccagagagctcagaattgctgcctctttcagttatttgggcatggcattgatgaagtactgaacaaaatacaccaacgtggcagtaaatcttatctgcccttaccttccctccctcataattttctctttctttctgtttcaactgttttacttcttcttcactcatcttcttaatttttgtttttgggtcagaaagaagcaactctggttgctttgaacccattccccaagatagtccatctccatgacctcccaactctgatcagttcccctgaacctctgtcccacattccaccccaccctggcccctgacccctcccatctccatcccgtggtcctgctatgggtgctcagtctggcatccatagctactttcccaggctcatcacctacacaaagtctctgctttagtcaacttgatctcttaatggtccccctcagaaagtgcagggccgcatcttcccctgccttcctggtgcttttcaagagctctctcaactccaaacccagctcggttcccacctcctccctgagccttctctagctgcctcaaccttaggcactgttctttcttctggatctgggtagaacatgcattgattatgcctgtagctcacttaggctgtcttttttttttttaacattatatccagtcaccttaaatactgaagggcaggcactggatcttgtagctataagtcattgctcagatctatctaggacactttcattcatatgatcctcaacaaacatttactgatgatgatgttaaaaactggagctcagaacaataactgctaatgtttatgtccggtgtaaaaacaaataacttccttttagggtatttttctaatgaagactccagtaaaccttaacaagaagctgttagtatggcttcacatgctatgagcaaatatagttccaaactctggctccataaatttctctttcctcttaaatcgttaataaatttgtgagtaaattacttgccatctgaattacagatttctgggtaggtgcaacgacgatgaaaatacctgcaggtgaattctttgtcctcttcacattttgctgcacattcttctctgcttcctgcccccagctgcttcttagtgacactgaacagtgaaggcccctgggtattcacatagtcatccaggggctctccttgacctagaggtgggagatccaagtggaataaatggtcagtaaatcaatgccaatgtctaattgtcatgacttccttttaatctatttggttagcattaaccaaataaaacttgctgtttactggaagtagaatgggtagctatgaatcaaaatgtttagttaagaacacacagttgggcatgtggacataaataaagatggcaactaaagacactggggactaccagagaagggagagagggagcgaggcaagggctgaaaaactacctatttagtaggtatttagctcactacctgggtgatgggaatcatttgtaccccaaagctcagtgtcacgcaatttagtgatgtaacaaacctgcacatgtacccctgactctaaaagttgaaattataaaacaaagaaaaacagtttcattaacagattgcaagatagtaaaagattaactggattgataaacaggttagaactatggaaccactactatgttaccatattagtggatataaatccttaaacaagaacaaattttatgtttgctatcaattgtgccatgtcatgagagaagagtaaggcaccatcagtggcagttgtgttaccaagattgatgttgatttgttcatccctgggtagaaatggaacttggaggccattgtttgatttcctacaatatgcgctttggttctgacactgtcacttgaactggtgggaagcatcctctgaatggtccctccttgaggcacataaattttggtgcatagatgatggtggaaataaacaagaactgaactaaattatgttgccaccttggacaaaaattgggcaaaacactggagggtaagaagctccccaacaaagaaggccatttttgtactgggctgatgacagtcacacaacactactaactggggagaaatcagtttttccaaggtgttgacaggtatctggatttcggaggaaattgtaaaaaagcagaacctgggacaaatactggtcttggtttttctttgagatcaaatctgagacaacgaatctgtccgaaagctgctttctgcctggtcgtggcagagggtggccaagggggcctcagctgtgctcccaccacaaggctacagggtgttcccttgtcctgaggctcttccggacatctggctgagctttggtaggtctattccaagcctggagatgccagctccatccttcgcacagaatgctagtgattttcacaggggtaagaggccaaaagaggctaataaaatgaagatagccaagctccatggaattagacaacaggacaaccttgaccactttgaggggcgtggtgggggctgcaggcagagggagtgggttatagagtgacgaggagagcagtggaggcggcagcgggagacaagcctggctctgaagacagcgagccctccagggaagatgcggtcaggggaggttctgaaagatgacacactgcagagcacactggtttgtatgctgatgacaaatatccagtaggaaggcaaatgaacagattctcattctcagaaaggcccgtcctgacctcctgagggtacacagagcacagggaggaggatgcacgctcatcaattcatgcaaagtcctcggccaaagtccccctgctccccacctctgggacttcgtccttcctcaatttaagacattccgggctggaaaaatggattattgagcaggagttggctgatgcattctaaacctaatccactaaaaagcacttgagagatgtatcaaaagatcacaaagaaatagatgctttaggcccatatccatgtctttaccccgcactttctgccaacttgaactctcatttccaagaagagttgtgttttggttaattctatagctcgcagtgtgacttcaaaacacacaataaatccacaaagtgtgtcctacggtgagttcagttaaactttctgaagagtttttttgaagtatagcagagcaggctacaattgatattcaaaaaaagaaaacttccatttatttcccccttcaattaagttctctgtgtcatgttattatacttcatagcacatcgctgctgagatcccctccccagctcctgtccctaggaaatatcccaaaacagaatcaaactgttttctttttaatttgaaataattttcccccattttttttttctcttattcacctctaggactcatatggcaataggatttgatagggcttatttgctggcaaggaaacatcaaatcttttagtggaaaaatacatttatattataggcaaaatgcagatgtatattgctactgatgcaaatgtattttattaatggtgtgagaatttcttcctcactgtggtgtgtgaatgtgtatgcatatttgcatgtgtaaaagacttaatttgtgaaatggaagatgtttctccacttcccactaagcatggctgtaaaagaaactttttcctctccccgggcattgcagcacactggaaagatgatacatccacagaaagcctggctttccaaaagagcttatgagagaatgttccccccaggttggttaaaacattggtaatcctgtggcggagaagtttgttctagcctttgggtgtagcccactgaataagttcacagtgatctatgtcatagtttccatgcattgaaatataatattcacacccccaacatacaccaatttcttacaaaaatttctttaattttctcctgctctgtattttgtttgatagctccttgaatggcttccactaaattcaaatgtatttgactctaaagtgcaacttgtaaaattttatctggtaatttatagattgaatttcaagtatacattatttacaggaagaactactagcaaatcgtatgattccgttcgtatgaaatgttcaaaatggcaaagatataaatacagaaagtagattagtggttgccagaagctgcagatcgggggtaacagctaaggagagtggagtgcgtttttgggggtatgaatagttttaaaatttattctgatggtggctgcacaactctcaatatattgaaatccattggattgtatgcctaaatgggtgaattctatacattaattatatctcaataaagcttttttttaaaaaaagaaaaagaaaaagaactactaggacatgtttagaatattatttcaaaggcttaaacaaagctgaaaagtgagaagagccctagattccttctgggaaacctggcttaaatccagttttctttatttcccagatttgagaatttggtcactgagcaaataacatgattttcctaagtctagatttctttgtttataaaatgagggtgaatatgctaccctacctataccgcgagctaaataagctagtatttgtaaaggacacacactcacactcacattcacacacaggtatgtatgtatgtgtaaaaatgtagcgacctaacccaagcactaagtgagtatttgttgaatcactgtctgcacacagcatctggcaaatggatgcgtgtgatttttccggggattagaggcaaacgtatactgatggaaagccttcctcaggccataacaaagggagaaatgctgaatccctgacgctgccaccaccatgaactggtgagagaacagaatatattcaaagagaaatttcattgttttaacttgcaagtgaggggagcatgacaccgtaagagagattatataaattagtcaaactgagaaccaggcgaagagcttagccgtcctttgcatagttagctacattggctctttttcaattagactggccattatgtgggtgcactcatttagatttgaaaaaccacccattattttctctgcgcattcattccagcacgctgacaatcttcacaggaaaactaaacttatttcttgaagaattcctcaatcttatacaagattttcaactgggagtttcatgaatcaaaaattaaatgaattgcacataaagccatggcatatgtatttgtactgcattgtgggagaaaaaataattattataatttaaaaaaactatgtcttacctgatttcagaaataaaagaagtagaagaaccacttccttatgttccattttgggactggccagcagtgcccagaaagtgtgtcccaatcccaggatgttgttgacttacatgagagtaaacgcatccacagaccagatagtcaaattaagttaatgattctctcagacacccacgccactggctcagcagggttcaaacacgaccttgaataaagggtccttacaaaatgattgagggtggaatctgcaatagatgctgggaagtggtgaaagcaatctcccccctcagctgctccatgctgccttcatgtctccttactccttccctcacctttgtactttatctctcacaattagtcttatttcctcccctcttcttttattccctttcttttggagaaaatgaaatcagaaaagtatctcacatttgctggaaccttccatgacgagaccctctgccaagcgctgcacgtccatagcctccctcaagcttcccaacaggcagtgctgttctcattcctgctgtacgagggatggggctgaggccttccccaaggttgtgtcgctacccaggggtgcagctgatagacaaaaccctttcaggtcctggatgacaaacttaagttaggtgtaaatgttaatatctccacatcctacaccaaatgacatagaaattacgacataagtgaaagtatcttattatcttcaaaatttctttattcccagtgaactcacatgttttctgtaattataaattataagacatcaatctttcccccaaatgaacgtatggcatattattatattctcattctcatgaaataaagcaagactggtagcactaagtggaaagcgtctatctcaattttaaatgttgaatctgtacttttccctggcttaagtctagagcaaccaggtagtatatatgttgtaaaacttctattttagtgttcaaagatatttagcaataaatcaattgacctctctattttagatgtgaaataaggaccagaaagcattgttcctctttccaggcagtgaaattcctgcctattcattaactggcaaaagagtagaggtgggagcccaatggtcttgggtggaacgtcctgtggaattccctgggattgaggaatcatgcagaaccctcaagaagaaaccacactgggcaacaagagggtggccccatgtgaggaacagggggaccgaatcgcatttcctgatttcctattctagcctcactctcttctctcctcaaattcttaccactccctttatcctctctgactcacctcgtggcccagttcattaaaggggacagaaggtggaggcaaattgagaaaccagcagtgggcagacgttttatttttaatgtgaaatgtctcttagggggcttatgttgatgtgcttgagaaagtactttgggggaaaaaaaaactaactctactaatatataatgcttccagcatgtatttatttccacttaaaatattattgtagcagttcctcttggataaggcatcttgggaatgatgttatcagaaattctacatccacataattttcttttcctgtttttttggttttgacttgggtagtgttggtatagcttttgcccacctttcccctggtaggtgttagatgcattaaattctacaaatgcgattttataaattagttgccctcctaatggcctcctggctgtacattcttccctaccttcataatccatcagcatcgtgaaagcacagagggacattgagcagagttctgtgctggcgccaccgcactctgtagcctgtaagagagcagcaaagaggaatgagttgctcaggtatagacaggggtggatgcatagagacttccactgtggcacggcccttcatgtccagggtaggcatgaagcaatggactattccagattgtgcataggaaaccacactgcactcttagacggatttttgctctaaagacaactaattcaaaataaggtgctttctacctgaaataatggcatgaactgagaaaagagatatagagagagatctctgtgtactacgatcaggttgcacatattctgagatttatgtattcttatttagttcaattccttatttactgaccacttactgtgtacaatattgtattagattcttttaggattacagttgacccttgaacaacttgggggcttggcacactgaccgtacacagtagaaaatccaggtataattctgattcccccaaacttaactactgatagcctgctgttgaccagcaacagttaataacatgtattttgtatgctatatgtattatatactgtattcttacaataaagtaagctagagaaaaggaaacgtttctaaggagaaaatacatctatggtactgttatgtatttatccatacagtaagtttacaccgcctgtttacaagatgaatcatctgtctgaaatggaagcaaccccagctacagacctcagtctctgttacatatcaagcaaatcaagtttttcttgtaatgtcaaatgtcatgacttttctctgcttcttgggagcacttccagcatcactagtgccacttcatgtggatcccatggtgttattcaaggtttacagtacagcacgaaacaggacgaaaaatacatgtgaacagggagagggcactttttactgggatgcgcaattcactggggatgacctgctcatgatggaatgttgagtatcacagaacgttttaagtggatacttgcaacacctgagctcattgcaacagcaacaggaggaggctatgaacttattaccgtactgtggtatgcactacggttaaatttatgcagttacaatttaatactgcatcttgatgtttgtatacacttctctcaactgagaatagcaccatatacgatctgtgagtgtgtacataagttttactaaattttaacttttgcaatagttttgttatattttatggtagtaaataataaaatagactaggtatctacatacattttatgcattcatgacatacttaactttttctatttttgttgatatttctagctgcatggtttgtctttgagttttttcaaattgttgcaaaactccaaaacattttctaacacatttattgaaaaaaatctgtgtgtaacagttcagacgtgtgttgttcaatgatcaactatatgtctaaagagtacaaatcagtctgtaaccttccccagcctctccatgctaaaggaactacaggaaactttcgcactcaagatgtgtggagattctgctgctgcacttgtagcaggcataagaacgttcaaataggccgggcgcggtggctaatgcccgtaatcccagcattttgggaggccaagacgggtggatcacgaggtcaggagttcgagaccagcctggccagcatggtgaaaccccatctctactaaaaatacaaaaaattagccgggcatggtggcatgctcctgtagtcccagatactggggaggctgaggcaggagaattgcttgaacccagcaggcagaggttgcagtgagccgagatcgtgccattgcactccagcctgggtgagagagcaagactctgtctcaaaaaaaaaaaaaaaaaaaaagaacattcaaataagattggagacaaattgaatttccttagctctgcccagcataaggcctgcaatcaagatccactcaggtcctcttatgaaggaatagacgtctcttccagcattaaaatggtaaattccttgcaagtatttacaaagaaagttataaacaccaggaaacatcaacctcaccaggaggtgaggtagagttcacccttccatctcacctgaagtggaaaatgcagccaagtcacaacttcctaggtgatgcacgtccatgcaagctggactgcattgctggcctgacatttgcacctggcagctcctcgccaccccctctttccaccttccttgagcccaggctctgctgcccgggaactgccattctaggacagctcatttcatcaagatgaacttctctgaatagccctaagaggacagtatcatttccaactggaaatagcaagaacttaattaatctactaaggattcatataaagcatccctctgtcgtggtaagggtcctcggcaagtttatctgtgccctcgatgccaatgtgcaggttgtttttactgctgttttagtgtattagagcatatcagcgaggagacttctactaattaacctggaggtggctcttctttctttagttgctcttttccacatgttagcctttgttcatcagtccccaggaccatgcaatgaggtgcttatcagccctcatgtcccgtaaagagatagcaggctatctctcaagttagcacagtggttaaaacgtaatccactagggggcattttcctttcctttctttctttctttctttttttttttttggaaacagaggctggctctgtcacccaggctggagtgcggtggtacaaacacagctcactgtagccttaacctcctggattcaagcgattctcccacctcagactccagagtagctgggaccacaggtgcacgccaccatgcacagctatttttttttttttttttgtattttctgtagggacagggttttgccatgttacccaggctggtcttgaactcctgggctcatgagatcctcctatctcagtctccagaagtgctgggattacaaatatgaggcactttgcctggcactaggagacactttctcagtgagacctaactcatttggggctcagtgaggtgatattttcttaattgagttgtgcttgaaaaaatctagatatctattcatctttgaaaaaattaattttcattggctgtctcctcatcattaataagcatggctgtgttacatgcttaagacaaatattagcagagaagaagaaagtcagacccggataacttagcagcctgcactgaggtggcaccaggactccccagaggagagacgagggtccttctgctctgaggtccagactcaccatggataaaacagagttgcaccaaatcatccttcccatctctcacattgattgttctctaagctcattcagagaaaaaaaaaatcttatctcacagtatgtcagggagataagtcatgtagaaaaaccttaaaatattttcaggaaagcaaatgagtgcacaaaaaacctggtgaaatctgagcaaggtctgcagactagtttctgatattgtgccaatggcaactttccagttgtaatcatgaactatagttatgtaagatactgcctgagggaggcggggccataggcacaaggatctctcagtactatatttgtaacttgttgtgtttatacttatttcaaaacaaaaattatatgtatatatttatatatgtatacatgttatgtttgcaacacatgtgcctatatttggatacatgtgtctattttaggaggacctaggatgatgtaactgctttcatactagttaagagaattcccaaatttcagggaaagtctaaagttatagagttcctaactcagggtgcagaactcggactttggctgattctcgtgagctcctgggatgagtgggtgggacagagaggcttctccaccaccacactccttccctggctggagaccagatggttaaggactgatgggtgccagagagcagcagccctccatgtgggtccagaacccagaggctggagtagttcatgcctgctcctgcctcccaggtattcaagggaaacccaccatctccacacaccagcaaaacaccagcaaaacagaggccccaagtaatgacttctcctttctcatcttatcttgccacctgaccagctcctgggctcctcaatccaaagttggggaagagagaagggaatgtcagtggaaaccacttttgctataaactctcatccttcagatgttctttcagtgggtacagtgtttagtgctgtgctaggtgctggggaatcaagagtaaataagaggccatctttgccctcagggagtttttggtctcatgggtttggggcaatgcaggtctgtaaactggaattgtaaaagtgaagtggcccaggtcccatttgttgtagtggtgcacagagagacagtcttgagaggtgaggagacatttcccagaggaagtaacatccaagttgagacttagaagacagctggaaggatgagaaaggagaataattctgtggagtcctaattaggcaaaaggaatcaggctggtgacactgaggaaaaaagaaagagaaagcagataagctgtaagtttgcctttcttcatggtccaggaccatagccctcctgcacaaatagctcacaatcttcctgtgcccagctaccatcaggccctcagctgatggaaaaatgcaggttatcccactgcaaccttggtgttatcagtactgcacaaagctctcttcagcacgcagcaaaagcaacatcctataaaacccccagcaagcctttgtctcttggcattcagttcctctcttgctggcctgcctgttgctgccttgcaacatattttcatactttcttcaataaatctgcctttatctacaactgtcttggtaaattcttcttactgcccatggtatactggcctcagatagttgcttcacctgctacacattctttaagcagaagaaatatatgtgcagggtcccagaggcaggaggagcagacagatgagaggaatttggctaacatggggaaatggtccaattgcgcaggcttctcactctgtttcaagaagtttagacttcagccaaagaaaggcagggactactgttactgaaggcttttaaaatccaagggtggcttgatccctctgattgcagcacagtgaggaggtcataggaggtgagagatgagagggggtgaaagaaggcagtggagaaagagaaaaaagaatggattagggggatgttgagaaagtagaattgacatgattttgtgactcattgaatgtggggaatgaaatcaagtatgctgcctgaatttctggcttggacatctggtggacagtggatcattcattaagaaggaatgcataggagggaataagatgaaattggctggggacaatgttatgtttaggaacttgagaaaacccaagtggaaatttccagaagggagttgaatattctggtttagaacaggagttggcaaactatagcccatgaagcaggcttatttttataaatcaagttttattggaacatggccacacccattcttttactattttctgtggctatatttgcaccaccttagcagagttgagcagatgtgacagagacagtacaatgaccagcaagccgataaaatatttgttatcatcgctttacagaaaaagtttgccaattcctggtgtagagcctaggaaagaggtctgagctggagatgtggaatcagcagttgtcagcagataggtgggactgaagcaatgggggtggacaagcttgctcagagagaaaaaaataagccctaggataaagccctcaacaacacaaggacccagaagaagagaattctgtagagatgactgagaacagttagccagaggggaaaattgacagtgtgagtccagagaagccagcaaaagtgaaaattgtaaaaaggtgggagtggtcatgggtaccaaagacttgtgagaaatcaagtgagatgtatcctgtgtatgccagaaggtaagagcaaatgaggccaacataaccttaataataccaatctcaatggcccagactccagcaaagtctactctagctaccgctaccactaaacatatgtaaaactcagtaaaatagcaattttaattaaacaaattcctgacctatctctgtaatactcctttcccaacatttttgcctgcatattctttgattgcctcttcaataatgttgtaatatcatagtctatgagagaagagaataataaactattttggctctagtattttattattgatagatttaaatttttcttctggcttcatagctcaggatcgataatggaagataagttttcaggattcttggcacacttaggaaaatctttatcaaactatttttatgtatgaactgtaagatttggaataattcccagatgggatgagctacactcttttctagctttgtacatttctatttttcttattcaacttttattttaagttcagggataaaagtgcagggttgttacataggtaaacatgtgtcatgggggtttgttgtgcagattatttcatcacccaggtattaagcctagtactcattagttatttttcctgatgctgtctctcttcccatcctccaaccctgatgggccccagtgtgtgttgttcccctcgatgtgtccatgtgttctcatcatttagctcccacttataagtgagaacatgcgatatttggttttctgttcttgtgttagtttgctgagaataatggcctccagctccatccatgttcctgcaaatgcacatgtcatgtgacacaatcgtgatgtaatctatggtcttgcatatttacattacaccaccaggtaaatcagcacgagggaggtgaagactattctgaatctgttttacacagggacagctagcaataaaatacacagaaatgactccataccacataaataaatcccatggaacccaaactcaatgactcaattcttcttttgctggatcctcaaaatgcccacatccactccaccaccacccaacatgagggcagaaagagatcagaattttagccaattacagctaaaatgtctgcttttgtcaaaagcaaatgaccaaatggatacattgccagggcccctccagagcctcagaaagggcctgctgaagttgccttttgctatgggatgaatcaaaccaaaacacagtggcttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcctatgcttccagggggaatgattcacaacctgggaaacctagactttacacactggcttttcttcttgttttaaggtagagagaaattcttaattgtaatgtggtcaagtgtgtcagccttttgtcgcttggtttgtgctttttgagtcttccccaagaagtccctccttctcaccatgaggtcataaaggtgttctctcgtgactggaaattttcacgtttccacttaggtccttgagccatctggaatttgtgtctgatttggtgcaatccagctctcctacagcctggctgggagacttggagcaagtcgggctccctgagtccccagctaacagatgagaagattaattaggccatctctgtggcatcttcatcacctacagttgcaaacattcagtcttccttgctgcagcctgtgaccagggtgatagtccagtcagcgtgataataaaataatcccgccgacttccatgctgcaaaaatgcagccacgctgacatagcattggctgtcctccccagctctcttccagaaacaaaacaaagcacctcaaagcaggtttcccaaggcccactcacggccagaactttgctttaaatcattccccttcgacagtttagttttaactatactgtatgtacccaagccaaggatgggaggagaagcctcagtaactagaattgttattaaaaccatatatccaactccactggcttttctggaaacctctacctaaaggacgtttaagtcgtctattaaaatatttcagacttgccctgaaggaggcaccaagaagtgccacaactttgcaggctagtgaccacacagatggaaatgtgtctctggaagcaagtggctggtgttagaaacacacacacacacacacacacatacacacacacactcccacaaataaaaatctagtcttccgtgttcactcgaattattgtaataatcactgaggatgtgagactctgtatttagtcagttctctaagtatgacccagcccagccgtaagaaaacatgggagggatgggtgaagaccccacagaggagggagagcctgactgaggggagccagccttcacaggggtcccggtggggatgcaggcaagaaactcagcccaagctcatctaaggtggaaggtatgcgtctgatcaagatacaggggcagggaggggtggtgtcctacaattctcaagggcctgagaaggaggccaggagcaaagttgtctgcccatcaggtccccaggtcctaccaaggcagagaccagctggtctctctgtcccagtagaaaattcctctggagagagaatctgattggcttgagatctgtgattaattttatgtgtcaacttaactgggccacaaagtccccagatatttggttaaacattattctaaataggaggctgggtacggtggctcacgcctgtcatcccaggactttgggaggccgagatgggcagaccacaaggtcaagagtttgagaccagcctggccaacatggtgaaaccctgtctctactaaaaatacaagaattagctgggtatggtggcgggtgcctgtaatcccagctactagggaggctgaggcaggagaattgcttgaactcgggaggcagagattgcagtgagccgagattgtgccactgcactccagcctgggtgacagagcaagactccatctcaataattaattaattaattaattaattaattaataggggttttctggatgagattaccatttagatcaatagactgggtcaagcagattgctactgtggtgggcctcatccgatcagtagagtcttgggtagaacaaaaaggctgaccttctgagggcaagagggaactccccctgcctgagtacctttgaacagggacactggttcttcctgggttgggagcctgctggccttggaacaggagctacaccattgggccttctgggctcaggcctttggactccaacaaaggcctgtgtgagaaatgatgtcgagaactggtcagttctcctgggtctccagctcgctggctgcaggtcttggaacttgtcagcctctgtaatcacatgagccaattaatgcacatcctactcttctctcggctctgtttctctgggggaccctgactaatccaaggtcccacagaacacaggtgactcctcgaggctcatctctgtggatgggagaggcagttcccagacaagggaacatcatgagtggggcagacacccacagaggcctacagtggccacttcactccaggagccgcacacctagctgcaggaacccgagccccagtgactagcgctcatgggaagggcctgcatcccagatatgtgatgacagcccatcccaaaggccagctcagaaaatgctaggatttgccttcacccccagtggggtcatgtgtatgaggggggcaagtgggaagggagactttggaccccaggccctgcccatcagccaccccatggctgaggggtcacccccataagctcttgaatgccagcacaaggcagtctggggaaacttggtgacgtggacagagcccctccttcagggaagtttctagactgggctgtgtgcttggagccactgtgctgggcacagcctcccccagttgaccatgggctctccaccatgtgctcctgccttagaatcagcctccttctctgtaagtggagatggccctggcggcccaggtatgagaggccccaatcaatggcacttctcccatccacctctgagctagcggggaaataagacacaagagtgaggcaggaaaagaccaaagcagcaacagccagggcctcttcccagtccccagggagcccctcggcccctacccactttcaaggccagcgatataataagtttgtttttgttttccaaataaaggtttatttctttctgcttaactctttttcaaaaaatttgattttattgtgctaagaacacttaccgtgcaatctcccctcttagctggtttctaggggcacaatacagtcttgttaactctaggcaggtgccatgcttcatggccggtccccagggcttattcatctcactgcactgaaacttgaggctctttgagcagcagctcttcagtcccctcccccagcccctggcaggaccatgctcctgtctgtttctgcgagtttcactattttatatacggcacgttagtggaatcaaacagtgttttgtgtctgccttcttcacttagcatcatgtcctccagattgatcaatgttgcagcatgtgtcagagtttccttccttttttttgaggctgaataatattccattattccattgcgtgaatacaacacattttctttatccattcatctgtcggtggacatttaggttgcttccacttcttggctattgtaaataggcttctaggagcataaggatgctgactgttttggataaatacccagaaatggggttgctggatcatatggtagtcctctttttaatttgtgatacgtttcatctctcactctggcgatgtctgagcttctcccttgatagaggtagaaagttccagagaggcacaggcaggcccgcagtgagaaggcctgagcctccttaccagggtatttctcccccacgggctgcctctcgctaactgcacagctcaatcacacgtcccttcccagggctgctgtgtgtcacacgctcacacccacactcgctccatctgtgctgggtcgaagagtgaccctgtatccacatccatccaggacctcagagtgtgaccctacttggaaatagggtctttgcgggtgtaactcattaagatgaggtcatactcttcatgttggatggtcatagtacatcaatgcctgttgttcttatgaaaggagaaaacagcagggccaggtagctcatacctgcaaccccagcaacttgggaggctgaggtgggaggcttgcttgaggtcaagaatgtgagaccagcctgggaaacatagcaagactccatctctaaaacaattttaaaaattaaaaaattagctggtggcacatgcgtataatcccagctactggggaggctgaggcaggaggattgctggagcccagctggagctgcagtgagtcgtgatcacactgctgccctctagcctgggccacagagcaagaccacgtctctacaaataaataaataaataaatgttttaaaaagagagccagggtctctctcttctctctctctctctctttctctctctctctctctctctctctctctctctctcacacacacacacacacacacacacacacacacacacacacacacacacacacgagggaatgtggtatggagacagaggcagagattggagtgactcagcccctccaaagagtgccaggaattgcaggcaaccaccagattcaggaggaggcaagtaaggacccgcccctgcaagtttcagtgggaccatgaccctgcccccacctcgatcttgcacttggagcctccatagctgagacagagtaaattgctgttgttgttagccactcagttggtgggcatttgttactgcagtcctgggaaacaaatgagccgtccactcactcatatacagcctacttctattttactggtgctttctgctaactcctctcctttccatctacatatttcctccttccagatctccctcacctccctcaagaggggctctgtggccaggaaacttttaatgagatctggaaaaagtgttacttgcacattaaatccattattttatgaatatcatggcttaagacaagctgaagtttaaaagtgagtgatttcaagttgatcagaagaaaaatatcaagtaaatggggtgcatggtgacacatgagttgctgaaatttggggagcactggaatgcaagaaacagcactgattcagggtctgtctgtaattctgggtccaaattctgctttccctactggcactgggacacacaggcattgttgaagtgctggaccccagatttctcttctgtaaaatggaatcacagggtctaaattggaggctttctctgaaggatgagaataaagttagaatgagaatgttcctagcatggtgcctggcatgagcagattctcagcagatgggccctcctgtaatccgctgagggctctcctgcagtgccagcagggatcctagtcattgtccccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatgatggctctcattagccctaactcctcaggcaccttcctacctggcaccattatgctgggactaccctctcactctgggagcttcacgataaacccatcttggcttaccctggacgcctgtcagctcctggcagggtgcaggccagagggataccttttgcatcatgagattgtgcaacttgggaggctgaggcgggaggcttggttgaggccaggagtgttctggcaagttcacggaaagttctggcaagtaggcaggccagcctcttgcttagacagtgctaaaaggattctttttcactatctgccagtaaggaaagtggccatcttgttcagaggacggagtgcagcatccacatacctaccagcatgaacttggtgagcagaggccacctgcatcccagagccacagggtccctggagctattggcttcttgcctggatacttccaggattcccagtttctggaagctctggttgcagtgtgccctggttctgtggcacccagcaggtctgcaagggcagccagtgggtgtgagtctggagagtgaacatccctatgagaactgactcgtgaccctgagtttatcaccaaggggcctctgcagagacaggtcctcaaattaagagccaggcaaacctgtagagagagaggctctgggggtagactgggaggagtggaggatggtcaactgtccccacgcacttcacgaggattctccacctcccatgtcccctggcatggggagtgcaagataacaaaaaaaaaaaaaaagagaaggcagtgagcaggacccactcttcctgcagcttcttcacactcttcctacagccccagctgggccacctgcaccagtctgtctgcatctggggttggggtaggtgggttctggctggtttatggagagcctgctcctccatgaggtccatatctgttatttttccgcggcatcagcataagaggtttctggttttatgtatgtattttctggctctggctcctggtctgcatttgtatgcacaagaaggcataagagagatagagcactggatttccagagacatgtgtctggcagcattcgggaaaataacattatagcctaggaatcccatcacacatatgtgcacacatgcccacatgcaggatcatggtatgttggtggtggtgcagtttgtgcccatgaaggaaattgaaaacacttgttggagagaaaacccagtcgctggcatactattcccatcacagaagaggcagagcctatgattggtgcctcactgaatcacaggaagtgttttattttatccccacatcatgatggagggccacagctgccagctatgtctatttcttatgcacaatatagaccacaagagagaataaaacaacctcaaaactacagtgtggaaaaaaacctgtcagctagaaagggggagaaggtatctccaggagccaagaaaatctcttcaaggaaaaataaaaaaagtaacccactttactttttccccaaactgacaaatttgacttgtcagatgtaagtttaacttgtggacaatccactcaagactgataatcgccatagtaactgctgtgtcacatgatcacacagaagcctagagacggggaaagtggctttccaggccacttttcttctggtaaattctgtgatgtcagcctaattagcaggagtggaatcaggaccttggttgaagtaattggcagcccttctttaaaaagaacaaaggtattttagcaccttctcttcctgtttatgggggcctgtgccaggaccaacagggctctggtgcggagtcttcctcacccttcttcctaactggccaagctccaagcagtgcctctaaatgtgattctttgtagagccatgtctggagaaaaactcgaatttatctcctgaagttttcaaaatatcagaaactggtgagagagggggccgggaatacatttcagggctatcccgtttctttttaattagtattgtacatttcaacttctttcatttccaactgcttctccctgcaaaataaaggtatcatgtctttaaagctctccgtccatgacaacattttgttcttatactagaaaatgccattcccttcccaaggcacatctcttttagttgggtttaatttgagatgcctcttgcctgctaaaaacattggtgacttgccccagcaaggaggtgacagggccacttgtccatgttggccccctccagtgggactgagtggccaccacccccagtggctgcctttcacaggaagagaactgccttcttcaccgccgggcatcggcctgtggaaatctgtgcccagacagctcaggtggcagcttatccaagtccccagcactctgctttgtctgccccaggacaattgccccattgtcttcaggctaatgaagtttctggtcaaaacacaatgatttcaaacatctcttgagcctctctgccctccatctggaacagatgagtacatcaatcccttcaaacctgcctcctccaagtgcattctgcagagttagtgtgtgggggtgcattttaatcaaccacgttggccaatgctgcctacctggagtgaccccaacccccaactaaactgtgagctgtggaaatgaacagaagccagccaaatgaggagcaaaggctatttattcagagcttgtgctagcgagggagtcagccaccatcccttgtgttttggcagaaactcagaggcaggtaggggagtgggaaagcctcaaagaagaaagaaaggaagccttcgggttgccctgagtggagggtgttggcctggggaaaatgaaggtggctataagaaatgagactcccatgtgattggttagggagcatgtttggctttctttcattggtcctaagttggaagtggggacaaaaacctagggaatcaggctgggcatggtggctcatgcctgtaatcccagcactttgggaggctgaagtgggcagatcacttgaggtcaggagtttgagaccagcctggccaacatgttgaaaccccgtctctactaaatatacaaaaagttagctgggcatggtggtgtgcacctgtaatcccagctactcaggatactgaggtggcagaatcgctcgaacccgggaggcggaggttgcagtgagctgagatcatgctgctgcactccagcctgggggacagagcaagactccatctcaaaacaaaaacaaaacaaaacaaaaaaacctaaggaatcggtcagttattaatcgagtcctagaattttggggctgattgctataggagctgttgtttggcttctgggatgattgctacagattgtgggtcagagtcctgtctttctatatggtcttgacattgtctgtatattgactctctcagtgtgtacaggctgtcttctcccagcctgcttaaaattaatgagagtttgaacagacgagtgtgtggagggcacatcatcattagtacaaatagccacagatggaaattctgcatgcctttgacagaactgagtttgagaggctctacctcaacagcttcctcagcccagctgaagtctctctccctgaaggcccatgcacctttctcagccattgctgggaattcaggattgtgtgttggaggccaacattgggtaccatgagtggaaaccatgaactggggcaagtcctcctggtacacacacccagctactttttccttcctcttctgccccatcccagggaaccctctttgtaccatcccacccactggccaaacttcagggtcttgtcttcatacttactgcttttttctaagggaaaagttattgagaaggcagtcaaggttcatttatttttaaccaggagacagtgcccccaaacaagaactgagtccctagttatggaatgtcagacacctcgcagcaggtggtggttctgaaacacccggatccagatggcagccaactccacccacatgtcaggcgggcgacagcatttccggacatattccttgtttagatgaggagattctgcccccagtaacattccttcaagcagcaaaatgatgctagatctttccagaggtcacagactgaaggcttgggggctacagtctggaatgtgttttgcttggcacacatgcattttaagttgtttaatgacctatcaagatttaaagatcaggagctgacctttcatgttaaaaagaaaatctatattttccaacttgtcttggaaaatgggatgctctggcaacacttggccatcttcccaccttcagatgctcagcagaatggcagctgccctgtggagaggaagcacctgttcccttccttgccactctccctggctggcctgcagttttctcctgtgtgtcacagttatggactgactgcttgtgtcctgccaaattcatatgttgaaatcctaacccccaaggtgatcatattaggagatgaggcctttgggaagtgatgaggtcacgagggtggagccctcatgaatgggattagcgcccttatgaaagagaccccagagagctctctcactgtctttccaccatgcatgaaaatgagatgttaaagtcttcaacctggaagagggtccctgccagaatccggccatgctgggacctgatcttggacttttgagaactgtgagaagtaattttcagttgtttacaagtcatcccatcaatggtattccactatggcagtccaaactgactaggtgactcaccttcttggcccagtgggcatttgatccagaataactcattactgtctgaggaaattcccactgtctcttttcccagaagtttttgtttctggtggcttcttgggggattccaggcacagtagggccaagcaatgggtatagagtgaccctacacctttgacttggcctcctgtggacttagatggatgggtgtgtttcctaggagccctctttcctgtcctcaacccttttcccatgagaaatgcctcttcttgcctcagaaacaaacgaaggggtcagtgtctgccaatgtctgctcagcccagagtgaatgtctgagagattcagtgtgaatgtgctggttgcctgctacagatcaggcttggcaggtggtggtaggtggttaaggttccagtttcagcatcaagtatgagttgttactgctcagagtctcagttttctcatctgtaaaatgggaagattcctagctctcaaatttataaggctccactggccgtgtgtaaaatgtggcaattagggaatactgttggctgttaactatatccaccaggacaggctggttatgctctggtaaaaaataaacccaaactcaatgtctgcgcccagcacacatttatctcttgtgcatgctatatggccatcttgactcagcagggttctattctctgtcacctttacttaggagtgttggttggaagaatcccccaaagtagtgccatcagtctctatggcaggggaaaggggacatggtgtatcaagccttgggcttgaaggtctattcccagaagagacatcattaccgcaactcacgtttcattggccaaagtgagtcacaagccaagtttaacttcaaggagcatgcccccaagcctctgattctaagtgctaccgccttaacacatttgagctcctgtaacaaaatgccataagctgggtgacttataaacaagagaaattatttctcccagttctggaggctggaaagtccaagaccaaggcactggcagatttggtgtctaatgagaacctatttcctggttaatagatggtgccttcttgctgtatcattacacggtggaaggggcaaacaaactctctggggcctcttttataagggcactgatcccattaacgacagctctgcctttatgacctaatcaccttccagagcccccacctcctaatgccctcactgggggctaggtttctccatatgaattctggggggacacaaacattcagaccatggcagcgctctcttccctcaccgcgtggctggctctccaactacaacaccatgccccatggctcacttccaaggagactttctggagaggtttgtcctaagagacagaagaatgcatcctgcctcaagttttagttgcataggttcaccctacagtgaggtaatagttacacattcttaatgaaaagatccaaaagcccaatacatcctgttctgcagcatataaagcatcttcttcagacctggtccaagactactctgggatttttgagtcagaagagagccagagcctattcagtatgctgtttgactctgatcccagcagccaccaccatgttaacaggatgagcagggctttcttcaactcagggttcctgtgaaattaaaaagaattctcatcttgactcaggattgttgaacactattgatacttcttccaaggtctcacaagagtttgcctcctctcattgccatgtgaagacctctgtgggggaacaatgcatgggttcttggggtattataggggactacagagaagtgtcacctccacccaacagcctgattcagtctactcctcaggaggaacacaaagtggtctctctagtgccatgaaaccccaaaaagtgtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggacagtatttcataaaaaaagaaaggcaaaaataattttcaaaaatgattcaagaaatgctgtcaaagatagcaaagaacagagtcctcagagaacagtgcccaggacaggataagcactcaataacatataacactgtgtagtgctgttgagtgctggctgttgttgagtgctagctattgttgagtgcttgttgttgagtgctagctgctgagtgctagctgttgttgagtgcttgttgttgagtgctagctgttgttgggtgcttgttgttgagtgctagctgttgttgagtgcttgttgttgagtgctagctgttgttgagtgattgttgttgagtgctagctgttgttgagtgctagctgttgttgaatgctagctgttgctgagtgcttgttgttgagtgctagctgttgttgagtgcttgtcctgcctgggccctgtttttagcctttgatgtacatttctccatttaacttccacaatagccctattaggcagctagtattattatttctgttttacagataaagattggttttagctcagagtagttctgaatcttataaaaagaaaaaaatatccccaggaactgaatcggctccaaaatagccccatcttgggctaaatatgggatgtgacaaagccaccatgaagctaggcccccctgtcctgacagctttccaccccttccctgcccctctcaccctgctttccaggggcaatgcacctccccacttctcctgggaggggtgggcatcctctcagtcccataatctgtgccaggcccacatatgaggacttgacaggattcagcagagatgcaggcctctgctctgctctgctcatctctttgcatatagtaatttaatgaggacaaaaactgcatagagctagtaatggcacgaccaagcagcagcttaagctttgagccgctaaactatgctgcctcctattgtaatacgattatattataacacaagttcaagagaccacccactgctttctttattggatcttccaataaagtggccatgctagtagcacaattccccacggaaatagataatgactattctaaaataaatccgaggacacacccagccacaaagtgggaggtgtattatacaaatgcaaccagggcctctggatctggcatttagacccacagcaacagcttgtgtttgctcagggctaagaatgcaggactcagacaccgagagcctctgagctgctgcaaactcatcaacccctccctattaaaggccattctgactaccctcagttttcctcaaagagcagttgagagctaaggtagggtagggagccaagaggaggcagggagagccagagatggcagccggcaacaggacacagaaagaaaagggacttcaaaggcagatctaataactcacagggctttttggtgcagagtctggagataatgcacagaaatgacaccttgaaaggggaaggaaaagaaggaagaacacatcatcagccccggacttcaggtggctgaaggagagaatgtatttggcatctaccatatctttgcatccttcaatgacacatttgtccatgtcactgatctttctggcaaaaaaaaaaaaaaaaaatgtgctgtgtgactggtgggatgaaggtaaagggtggccagatgaatcctctccacatgctgccacgctggccacccaggatgtggcctagaggtgcaaggaaccagacaccactggcctacatcaaactccaggccacagatggaaataggactgagatccctggacctggggcccgctcaggtatgaagatcaggtggattgaggatgtcactgccatcccctccaaaagcacctgcaggaagggggttgccatggtcaccatctgtgaacaggactcctcaaaatgttttctgttaataaattgccttcaagtaaactgaaaaaaaaaaaaaaagagggagagaattcacacaaaatgatgcccagtcttggtctgcatggtgaagggcccaggactgatgggcgggggctcatttgcataccacaacaccagggagagtcctgtcacctgccctcctgagtcctgaagaaaacccttcactccaattccctgtacactgcttctaaaggcaggaaatgtgtacagttctagaattacagtcacataaaatgctagaagaataacgtgatttatttaagtgcttagaggtacccccttgaagtttgtgttacctggaagttggcctcagggaaacacctcattgaccttctctcaaggataaatgagatgcagggacagggaagggagaaaggttattttaacatttcattcacagtccctgggattctttggagagcaccttaggaatgttcttaacctgagtcctcttactaagtattatcacatagtctgccaggctggcattattaaccctactttgcagctgaggcaactacaagagatgaccctatcgggctagtgaagtggaattcgccatgtactgcatgcagtcatgtactgcagtgaccaatccgggtctaatttctttgatgatatcattgacggggtagcaggggagaggcaagtgcaagagaagaaatggggtgaaacccactgcagggaagcttgggctggggcaggatcggggagccagggtatggggcatggttgggactgaaacccttgttaacactggctttagcaaaagaaatgggcaccacaatcccagaggacttccagaagcttcctccctcccccgcacctgggcacagagccttacctcccctgcaccctggccctgtctctctatttggcaagactcccatgtcatctgctcctctttacttcgggtccctcttggcactggaaatactaagtgaacccagcagttgcacaggattctaggaatttctcctttccaacttcctgaactggttttctaattcacctcagaggtaccttaacaaatcatgttccaaggccaggcacagtggctcacgcctgtaatcccagcactttgggaggtcgaggcaggaggacctcctgagcccaggagttcaagaccagcctgggcaacatagtgagaccgtgtctctacaaaaaataaaagaattatcctggtgtggtggtgtgtgccactacactccagcctggatgaaagtgagagatctctttcgaaaaactcacgctccacacaatcaggaggtctgccatccacagactccagacagatagttccatcagccagcaggagcggcatgggcaacgtcagtagcatgcacatcaggttagcttctctgaggtcacaaagttgcctggaagtggggaatccatgagggccaggccctccacaggaggaggacttccctctccagtcaccggcctccctgatgtggttccctcctctcagcccacatgctcctgccgaggtaacatgtccccccactctatgttagaaaaccataaagcccccaagagacgtttctaccaatcatctaaatattgagtttcaccttataaaatttataaaacgtaaagaacacttggaacagcccagttttaatgcctccagcttttgttttccaaagaacaattggtagacttggccccgaggggagcagagcccggctctcagacaacgagcctcaccagcaattctgtatcttcgaggcggcagaggtttttgtgatcttgtgtcatttctaaacacgacggtgtagatgggatcctcttcattttgcaaatgagaaaatggaaaaacccgagggacaaagggcctctctcaaggtgccatggtgagaaggaggcagaaggaagaggacctcgcccctgccttgattccactgactgctgtttatcacaccatgagtgtcttcagggagcagtcgttctcccgctggaatgtttacatgaggagcaaatgtgatgccatcacataattccagtgagggctggtcatcccctgcaaggctgaaatgaccctgtctgttttaatgctaaggaagcagcagcttttctcccactcccacacaggatgtgtgcagcatcttcaagtctctgcctcgcgtttctagatctgtagtgagctctccatggtcagggagtggatctttcagttgggtatttttctgaagcaactgtcattctttgctttttgtaacaagacatgtttttaaaatcctctgagagagaaagagtgttgccagaaaaggaatgaagagtgggagaaaggtgcattgtggagctgtctgagcgttggagtatgtcccaataacgaagagactgcggagaagcatcccctgtccccctccgtgttctaaatgtatgaaacctaacaaggtaattgcatgggaataacacactgtgaatgttatgtgggatttgaaattgtcatcccaagagtgaccaggtggagagaggaagggtgaactctttcagtctaaaagctatgttttaaaaggcagggttagactatgtttgtttctgcagtgtattttctctgcataaagggatttttttcctactttttctgctggtggacgtttcccttgggggagcctggccaatgaaaggtcacacagagaccagtcactctcaggaacaccagcagagccgggcagacacatgtcctaattttcccaggagcagactgattgaaccataggagggtctgtctgatgtttatcttggcagaattctcagatgagttagcaaatagtggctggagataaactgaaactttgagcaacctctggactgactctgattaccctccacaccctacctgcacagggaggagagaccacaaagccagcagcaaacagtaaacttttccaagaatcagagaggaaggagttcctgacaccctgcagcaaaaacaacctcaaaattcccctgaagacagacccatgggagctggggtcaaggtggccttgcgcttcaccgaggaggtgtcattaccaaacgtgctggacattggctacctacggaagaaagattaaggactgaaagaaaatagtggagaacatgcttttgacatgggggtaggacagggaaggccttgagcaagacacaaatcacaaaagcaaatagagaaagagtgatgtctaccttcaatgaaatgtgaaacttctgattcaaaatcggaaacctctataagctgagataaaagacaagcaacagagttggagaagatatttctaacatttgtatgtgtgcaaatgtatgtgtgtaatgtgcttatacatatacatatagataaatgcgtgcgtatacacatgaattctggattgttatctaggctctatgaagaattcctatctgttaataagaaaaaagaccaagatcaacaacctcatagacaagtggataaagaagatgaccagttagtccacagaaaagaaaatgcaaatggaagtgggagggcccagaggaactcttgctttatctaaattgtgttgattacgggagcatatgcttatattaattttataggtaaaaaaacagaaaaagtacctgaagattaaacctaagcaatgcgatgtgtcagttttgacaacacacaggaaggggctctcagcctgtaaaataggagcccttttgtgtgaagctgaccagatgcggagaagtttcaacagtcctagagaagaggaccgcaggggacagagagccagggaacagggcagggaggatctaagagggcacccggccaagcggttcactgcagctggtgcagggctcagctataccctggggctgggcgcttagcacagtgtggtcagatgaaggcaagcaagcagtggcagggactctccatttgagtcaaagtgacaagcagtgcccccagtccctgggaaggatgaaatccaaatttaattcccttctgaacaacattctacaatctatgcttcatttaggtatctgtaagcctaaaagagctgaaaaatcattttatttccccttccaatgtacaatttctaagacatttgaattatcgatgttgaagtttcattgagaatgagctgagtgtcctgctttcggcctgaaaacaaagcctcagccacagtcttcgtctcaccctctttctctctgtttattttcttttaaaaagtttctcccatttctttgttctttaacaaagagttgtgtgcatcttctaagctccaagtgctgcactggcttccagcagacaatggcaaccgtggccctgacctcatggcgtgactgaacggagggtctcggccaggaacgtgagggacgccagaaagaggacattggtgggcaatgaggggtcttccttgcgggggggtgttggggggtgtgctgtgcttccctagcagtccacgaccactggcaggggacaccccgggcagaccagtggtccaaatttataccagcgaaaagcaaatgctgatgccttcccaatcacggttccttcaaaggcttcagggttccttgggaagggaaaagaacattagttcagctcctgcgatgtgctgggactgtgctaggaagtttcacagatgctagttcatttagattggatatgcctcctggaccagtgtgctgtccattatggaaaatcaaaacagccattgcatttccatagtgttcacaaggagcctcatttctgggctcaggcaggctgaggcgttccagggttgagaatcagacttggtgactgagcaggaactgttgtcctttttctcttttgagatatgaaatttgcttcacatctcagaagagtgtgtgcctccatcccacacttgggacaagcgccgttattccttttttaaaacatctgtagaacatattaaatgctctgctttcttcacgggttaaatcatgctggggcgggaggcttgtggtgtaagagcggtgcactgtgcatccactagggctctcccgtcattccagttggtctccttgccacgccccagctcgctgcccccaggctgtcttggacagacacatttgtgttttgtaatagagcacatcatgcactattatatggggatattttataaaggagcccacgtgacacaaggaaactaggagaaaacaatcctagaaatccccaaagcttggaagcagggacatgcaagcgaggtacagcatatgctatcaagtggcaatgtccttccagtaggaaagccgctgttgtcatcagtttaggcaggtgctgggattaagcacatctaccactcagaaaataataccaataagaaccacggtccacatccaacatgggtctcccaaattctctaaaatgtggaagtgtgcagatcttagcatctctgtcctttctctcgcttcgaggaagttgggctcctgggcactgcctcatcagtcatgcccagtacctgtgtacaggtgcctcccctgctctctggagcatcgggactggaaggattgggaacagaacggagctttgattgatcctcttgtccgcacttgtgcctttcaactccctgtggtggagggtgacagtttagtctccctgtcttctcctggggtcccaccggctcctgaatcaaatcctgctcttcccctgcatgttctgagtggcctgtacactctgggctctctctctccttgacccctggaacaccacctctttggttcttagtaaaccggagccttcctacctggtagtagcactgacatcctcttcatccactggaagcttccagatcctggcccccacaacccattctctccccatagggcttccacagaaacacaacgtgtactgtgtgccaaatgactggcccagaggatgagtgagtgggggaccaatgtaggctaggggaggggtcagaagagaaaagttccaagagagtgggaacccaaggaaggcttcttagaggagctgggacacattggggcctgaaggaagtggacatttagacgatcataaagactgcagggatgtccaaccttttggtttcactgggccacattggaagaagaagtgtcttgagccacacgtaaaatacactaacactaatgttagctgatgaagaacaacaaaaataatagcaaaaagtctcataatgctttaagaaaatttatgaatttacgttggcccacattcaaagctgtcctgggccacatgcatcctgcgggcttgggttggacaggcttgagctaaagcaagtgtgttctgagctggagagaaggccagccccatggttcatcgttcgtggtatcaccaaccaatgatactaggaacagttggtgggtgcaggccctgggcagggcaataataagaaaaagcttagaaaagaaaaggaggaggaggaggggagttgcgggtcatggagggccttgaaagcgagactgagggtttggaccttaccttttcggcatactaccgagcaggaacccctgtcactgtaatttctgatgattctgccttccatctttgggaataacaatgacatagtcgactactcctctacaaaaagagtcgtcagattctttaaccatgtggggcatcttgttttggcatccacactagttctgttacagccaaagctgggggtgttggggaatgtcgcatgcttcaggggtatctgtgtagtgtgcattttacccagctgagctcacaactttaatgtgtgaaggtgatcctccagttcaggaggacagagttggtgcccctgcctgtaccatcctaagagaggtttctgcttcctgtgtcctgctctgtgggctccccaggtacccctgtagtttttgcctaatactttggaaccaacaataataacttatgaaatctttatttcaaacacagcttgaatttcatccattttcatcttacccaaagagatagattctctagtccgcaatctggatggtcagaatggagaaatccccttacctgcaaacacaggtcttttattttgtaaccactgtctgtctggttttctgttttggagtctcccagggtgatggtgccgccagataaaagttctaatgagagagggagggtgggagggaggttccggtggcaaggcagggcggaaggtaagcggagaccttctccaatcagaagtctagaaggcagggcacgcagtaggtctgcagaatgactcagaacccgcgtatgaatgctgtctattcatgggtccaggcttttgttaaagcctgggcctgcattttaaagagggagtcagggaactggctggactggtctgacaactaaggagtggtgaacacttcccccaggctagtactcaggtggatgaagtcatcaatattttctgggcagtcctaatctgtgattaacttttatctctgctgtgaaataacagcctccttttcagcctgctaacaataagttaacctggctgcccggctgggggatattttatgctgggctccagcagaggcacacttgagaagccatgtgggactcctgccctggagagagcccagagtagagggaggggtctgtatggtggtgggagtcctctcagcaatggtccttgtgattccggtatactctgatgtcctgacttcaaactcagcttacccaaagcaaatgtccactttcttccgtactcctttcttgtttaaagcctcaccactgaccaggaagtcttgatagagccatctagtaattcttaagtcctacctcatccaaccttgttttgactcctgcagtgagcacagctgccctcaccctcccctctctatgccctcacctttgcaggagactctcaatttctcagtccacatcagctctcagaccaccaaagcaagggttatttttctaaaagacatttgttcccattgctcctctgactaaagttcctactatgggacatttgcccttggcactcaaggaccttgcaatcaggctgagaacctcaggttctcaaactcaagaccatggggaatgtaataggtgaatcaggcaggtgaagtccaggactctttttggtttatattttgtttactcagttttgatggagacaagcataccagaaaattcacattcctcttaactctagcagtagacaaacaacagagcaagcaggatgtgaccatttatacatggcctcactgttggggaggcagtagggagtgttggagaccagggtcaggactagggctagggcaaggctaggaaggtgcccaggatgcatgttttaaggaagcactcactcttggggctttgcaagtacaaggctagcactgggagatgagtgcctccttaaagttggcttcttgggccttgtttgcctgacctagtctggccttggtgaggacagtggagaaatggagcatggacctacccaaagggatggctgctgatcagcttcacctagctgttgccaaaggcaacactgtggccccacttttgccaaatcttttcaaacattctgtgggtgcttccatcatagctattatcacctggcaagggagttgtccccacaggtaaccttctcactaagtgggggtgtctgaggccagggagagctctactcattcccctgtgtgatcccagcagtgagcatagagcaggtgccctgcaatgttaagcaaaaaaaaaaaaaaaaaaaaaaaaagactttggaaatagagttatggagccaggatgggtcttgagttagcctcactctttatttctttattcaaggaatggttgttcagggccagcggctcagccctgggagcactgactgcttcaagacacagactcctctgggatgccaggcagagtctgctcctgaaggcagactccactcttcatggggctccctccattactcattaggtcacagaataatagaaaaaggcaggaaagatgaaaaaagagaatttaagaacaaaacacgtccaggtgtggtggctcacacccgtaatcccagcactttgggaggctgaggcaggcagttcatctgaggtcaggagttcgagaccagtctggccaacatgaagaaaccctatctctactaaaaatacaaaaattagctgggcgtggtggtgggcacttgtaatcccagctactagggaggctgagcccagacaatcacttaaacccgggaggtggaggttgcagtgagctgagattgcaccactgcattccagcctgggtgacagagcaagactctgtctcaaaaaaacccaaaccccacccccccaaaacccaaaacacatggtagcaaaataataacaaattgaagtatgtctgtaatgacagcaaatgggaacttacctactccaagacagaaaatgattagattagatttctaaaaagtccaggtaggtcttgcttccaagataccatctaagatgaaatcacacaggctgaaaataaaggaatggaaaaatatacactatttaaatgctagcaatagcagacagattataataggagagagactatataataatcaaggcaccaaccgactcagaagctgtcacaggcccaaatgtatatgtatgtgtctaacatacacgcacctcaaaatatagtaagcaaattgacagaactacaagtctaagattacaacccatttaacttgatcaaaagttgataaatcaagcaatttaaaaagtactaggttataaaagatttgaaaaacaaaagtaacaagcattatctaatgggtgtgtgtgtgtaaaactttgcggccaaacataaatggtcatcatagatcatttaaaaacagttggtgatatacagattatttaaaaatttgaccacatactaggtcacaaagaactcaacaaatatctagaatcatcaaataacacagatcatattctctaaacacaacccaattaaattagaagtcaatactaaaatacagtctcaaactcatatatgtgggaactaaaaaattcactccctagtaactaataggctgaagaagaaattacaacagaaatttgaggagtttgagaccagcctgggcaacaatgcaaaaccctgtttctacaaaaaattagccaggtgtggtggtgggtgcctgtggtcccagctacttgggagactgagttgggaggactgcttgatcccaggaggtggaggttgcagtgagccattatcatgccattacactccagcctgggccacagagtgagaccttgttgaaaaaagaaagaatatctagaggtaaatttatagtctgacatgaatttatttcaaaatcatgagaggtttaagcgagctgagtgctcaaaatagcaattgtaaggaacttccttaatgtgataaaggttatctatcaaaagtgtatagtaaacattataattaatggtgaaactttggaagcatgcccatcaatatcagtaacaagacaaggatgtccattgtcaatatgtctattcatcagtatcctggaagccgtactgagggcaatgaaacaagcaaaagaaataggagtataagaatttagaatgaagcaagaatatttttatctgcaggaaatatgataatctatatagaaaattcaagagaattttctaataaactattcaaatgaaaatacagtccaacgaatatatatacacaaaattgggtacaatttatatgtattaattataaccaattagaaaatataacaggagaatgagtcttatatttcaactaaagctataagatctttctgcatacattaaacaaaatatgtgcacgttgcttggttttgatttttcttggttcatttggctggttttagaggaaacttggaaatacacctgagggacatgaaagaaaatattagtgagtggagtgattcaccacattcttaaatggaaaaactagtgttgatttaagaaagatgtcaggccgggcgcggtggctcacgcctgtaatcccagcactttgggaggccgaggcaggcggatcacaagatcaggagttcaagaccagcctggccaacatattgaaaccccgtctctattaaaaataaaaaaattagcttggcttggtggcgggcacctgtaatcccagctactcgggaggctgaggcaggagaatcgcttgaacctgggaggcggagtttgcagtgagccaagattgcgccattgcactccagcctgggtgacagtgtgagactccatctcaaaaaaaaaaaaaaaaaaaaggaaggaaagatgtcaatatcatctcctaattattctttaaattcactacaattctatccaaaatcttgaaggggatttttttgtgtgtgaaatttgacaagctgataatcatcaagactaattatacatttataatacttaacatagtacaatatcgatatatagatagtgaatagatcaatagaaaattagagaactcagaaactgacctatgcatctgtggaaatttcatatataacggaagagtcattacagattagtaaaaagaaggggtgggctcgttcaagaaataacttaggaaaaataggttatccatacaagaataataaaattagatccttatatcaacgcacatgtaaaaacaaatccttggttgattacatacctaagtgtaaaaagcaacaacttcaaataatttagaagaagatgtagaagactatctttatgaactcagagtaagaaattattttcttaaactatatacaaaaagacccttaatgcaaaaattaacagactatttggtttagtaagcaggattgtattttaaaatttttaaattattcataaaaaatgttaaatgtcaagccagaaaccagtatttgcaatgcagtcatataattgacaaaggccagaatccagaatacatgaacactggcaagtcaatggaaaaaatgaccaaaagacatgaacaagttatggatgaaggcagctcaaagggcaaatgagcatttgactagatgattacctcttagtaatcagagaaataagcaaacaaaaaagtatgccacctgtgtattagggttctccagtgaaataaaacaaataggatttacatgtatatagaaagagatttgttttaagaaattaacttccatgattatgaaagttaatatctcttccatgattatggaagctggtaagtccaaaatctgcatgctgggctggcaggctggagacccggagagaagacaatgctacagctcaagtcaaaaggccatcaggctgaagaccccaggaagagctgatgttgcaggtgaagtcccaagaacagtttgctggagaatttcctcttgttcagggagctcagccttttactctattcaggccttcaactgactggacgaagcctgcccaggctctggaaggcaatctgctttactgaaagcccaccaatttcaatgtaaatccccatcagaaacaccctcacagaaacattccggccaagttgacactcaaaatcaactacagaacctccaacacatcagactggccaaaacatttgtctgccactaccaagtgttgacacaaaaggcaaacataagaaactcatactgggctggtgaggatgtagagcatggatccagactggagaacctctcacacatgtgcacaaatattcactgcatcattatctgtagtgaaaaattgaaaaggaactgaaaaacaatcagcagaaaatagacaaattaattctgataaggttcatatgactgagtattatacagcagttaaaggagttagagcaacaggtatctgcatggataaatctaaaaacaatcatgagtttcaggaagatagatacaacaggacagatttccataaaatggaaaacttacaaaccaatactttatattacttaggaatgaatactgtaggaaaatctaaaaaacaggcttgagattaatacacagtaaatttaaggttgtggcatctctgaggagtagggaaagggaatgagatcaaggaggccttcatctgtgtctgtaatgttttatgtgtttttttctaaaggcttgaaacaaatatggcaaaatattaagatctgataaagccatgtgggcgtatgacatttgttatatttctctctatccttattcatgtgtttaaataattctccgaaagcagtttactgagagttcagcatgtctcctgagacatgctaggaagttatgtgcaggagtggagaatatgattcattggaagagttaagtgccctaaatgccagccaggctgtgaccccaggacagaagtagggtgggggggccttcttgcttgctagtgacaatctacaccaaccagcaccacaggagccccaggatgacaaggaaggacaaaacacagggggtgacagatgcaatgaacccctatgtggtacattgagtggtggagaccgggtgtaaaacacacgatcggtgcagggagaccagctatggaggctttggggaccatgataatgaccatccagtgtggctgtacttttctctagaagagggttggcctacatccactccagtggatccacattctctcccaagagactgataagagagtgaaagatttaagtcacctgtgtgggtggccctcaagacccctgcaatgaaaacccaaaggggtatcacagtgttttctggcaagaattggccattgcttaattttcttgtctgatttttcctagcaaccttgtatttgacctcgcctggcatcctgtgtggtcatgagccacagaggtggaaaaggcaacatggtagaggcaggaggaggcaggaggtggaaaagaagggttatcaggtgatgagttcagccatctcttgccctgagtttagttgtgctttgtttataaaaagtgcttttctacaaaaagtatttgatggtacaaaatattatcaatatggcttagatgggtttgagaagtaagaaaaggatcgtggtggtagcaggaaataagacagaaattttccatgggggctccaggtctgaaggcactggcaggtactgcagggtgcctcaagcaggcgtcacttgatagggtcaaaaatcagtaatgtctatgctcatctccaacctctgcagatagaggaggaaatgttgtgaagtatttagatgcattttcttaggtgcgttgtttttgttgaattaggacatgaagccagccacagccagctgtctctccccttcggtgagaaggggacgacgtgaagcacccaagatgtgaaccaggactcaattcacatttggggaacctgatagcctcctcagatgcccccacagaaatccagattgacccctgaggctgagctttaccctctgcagggatgacttccatccagcctgggatgggcaggggaaaccgctgctcacccgaagtgtatttaaggggtcccaacagcaacttatcaacattttttgttgtaaagcacagagagagcagtgaattctgtccattttgtgagcagcacatctggataaggcgggtgccccactgcattcagagcagctctgggaatgaggaaggaagagacaacaaaaggaacaggagccttccaataagcccagacattagacctgagccttgtccctgtcataggctagtcattattgattaaaaggtggacatcagataaacccaagagggacagccccgccaacgtccagagcaatgaggccctcactctgccctcacctctgccagtgtaaattctggggaatttctgaaacaccgtgaatacagaggtgtgactcagcgggaatcacaggaatgtcagaggacaaagcagttggtattaataaattgctttgagtctggaaacaaagaagtggccttctttgtttccaggctgaagtacagtgctgtgatcatagctcactgtaacctcgaactcctggcctaaaatgatcctcctgcctcagcctcccaaagcactgggaatacaggcatgagacaccatgcctggcctggccttcagtttctctgctctaactctgcgttgccctagaaatccttttctgaatttctcaggtattagacattcacccatgacatctgcatctttctcatcttcaccagaatcaccctgtcttaattccttaactcttcctgcttcttgccaggctaagaagctgtattagttatctattgctgtgtaacatgtcaccctaaaacgtggcagcttaaaacaaatgtgtgttatctcacactttctgtgagtcaggaatatggacacggcttagctgaatgcttgtaactcaaggctgctcatgaggctgcagtcaagctgtcacctgaggctttggtcttatctgaaggttgactggcatgggggcatctgtttccaagctcactcatgtggttctgtccctccccacctaggcatctccacaggctgccttgtgacatgtggctggttaccctggggtcgtgtgactctagagagagtaggacagaggacccaaaatggaagccacagtgctttttataacctatgaagatgtgacatctcattacttctgccctattctagtcatagaagcaagttacttagaatgatccacaccgacagggaaaggatgacatgagggtgaggatacagggagagtgggggtcactggggcccatcttagaggctgcctaccacagaatccctaattatttctctgaaaataaaaggaggagaaagagacaccatattctacatttctgctcacctctgtggtggggctgatgtgcatggttttcatggcttaaaagcacactccatctcactgggggtttcccaaatggtcatatgaagagaggaattgctccccagaaccgctggggcacctcatttcgttgatgctttttcttcctctccacggagatgctctgggtagaaggaatgaagccttcaaggtggactctggagggctctcccagaggcttctgtctgaaccagtgggcttaaaaatgagcaagggagaaccttcatgaaaatcactgtcaagtactgtctcagtttgctccagctgctgtaacagaataccatagactgggtggcttgtgagcaatagaaattaatttcttgcagttctggagtctgggaagtccaaattgaggtgctggcagattctgtgtctggtgagggcccacttcctggttcatagacagcctactcctcgctgtgtcctcacctgaaggaaggggcaaggcagctctttagtgtctcttttatgatagtactaatcttatttgtgagggctccactgtcatgacccgagcacctcccaaaggtcccacctccaggtatcatcccactggggatcaggcttcaacacatgaacttgaagacaaacatttggtctatagcaaacacccaccatataccaagccccgtgcttctctgggcttgggggtgctgggataccaaggtaaattaagcctgggctccatggcaagctggtgtgatggttgagagaaggtctaaggggtcagtaaggggttcttgcctggcacggtggctcatgcctgtaatcctagcactttgggaggctgaggtgggccgatcacgaggtcaggagttcgagaccaacctggccagcatggtgaaaccccatctctactaaaaatacaaaaaagtagccgggcatggtggcatgcacctgtaatcccagcactttgggaggccaaggcgggtggatcacgaggtcaggagttcgagaccagcctggccaacatagtgaaaccccgtctctactaaaaatacaaaaaagtagccaggcatggtggcacgtgcctgtaatcccagctactcgggaggctgaggcaggagaattgcttgaactcgggaggtggaggttgcagtgagccgatcatgccactgcactccagcctggatgacagaacgagactccgtctcaaaaactaaaataaaataaggggttctcatcctagtgctattctcagctgagtgactttgggagagtgacttgaccttcatgagcctcagtgttcaaaggatctttatgattatgtttgtgaagccctccgagtcacctctgagtctgagcatccatctaggtgctccatcagcagtaggtattcccagtgctattgcagagaaactctctaaacccacctctcaaactgggccagcctggagactggacccagtgggtctggatgctgacttgagcacacatgtacctcggctcctcaggaaactctcatgcaccccagtggctgggagccactggtctagagagtgagctgcatcaaggaatggtggcacgtgggaatgtgagcaggtgcaggtggacactgggccaaggtggggcgtgtctggactcagggcctcgttggccaactctcctaggacttaagaagggagaggagcccagatagaggagccagttttttttttatttccaacttttattttaggttcaaggggtaggtgtgcaggtttgttacatgagtaaattgcatatcatggggttttggtatacaaataattttgtcacccaggtaatcagcgtaatacccaataggtagtttttctgtcttcaccctcctcccatcctcccccaccaggagtccccagtgtcctctgctcccatctttatgtccatgtctactcaatgttgagcccccacttataagtaagaacatgcagtatttagttttctgttcctgcgttaatttgtttagggtaatggcctccagctctatccatgttgctgtaatggacatgatttcattcgtttctgtggctgcacagtattccatgttgtatatgcaccacattttctttatgcaatccaccatcgatgggcatctaggtctttgctattgtaaacagtgctgtgatgaatatatgcctgtgtgtgtctttatggtagaatattttgtattcctttgggcatatacccagtaaatgggattgctaggtcaaatggtagttctagtttaagttatttgagaactctccagacagctttccacagtggctgaactaacttacattctcaccagcagtgtagaagcattgaggggccagttttaaatcctagtcccttcctgatgctttattcatgctttattcctgcctcctgtcacccgtcttagggatgattcacccagtcccttgctcctggctggaaaaaccttttaaggaaaagtcgctaatctgggtacatctagacttagctttgcccgtggaaagtctcttgcttttcacagccatttgctacccaccctgcacctccccacacccctcagacttcatgcttgagtcctgtttaccaaatgatgggatcctgttttgtcacctcagtcccctctgaggggcagtcagctggctggagcaggaggctgctcaatcccacgctgcaggctcctgcacaaggtcagatgtgcaggccatcatgaagtgagtgtcgagggtggtgtcatcctgaaggttaacactgtagcggggagagcatggggttgcgtgtccctctccctccttgtgcaataactatcgtgggtaattcttttatcgtcttttagataatttttacatccacaaatcagaaaaggaatgagaatcaaacaaagtaatacatgtggaagaactcagagaacagtgtcattctatagcaacaatcaacacagagcctctgctaagtgtcaggccacattctgagcacagcggagacaggattgagcaaagccaccacagagttcacattataaaaatgaaacaaatgaatgacaagtgtcacacggggtaacaagcacgataggggagacagaatgaggagagcatgtttaacagtaagaggttcgggaaggaagccggcccagacctgagtgaaattagccatgcctgtgcccgggggaagcaggtgccagcaggaggaacaccgagcccagcctcctgaggtggagggcatggggcatggtaacaggctgcacaggagctctgctctggagcacgcgatccgggcacaaccaagagcattggtggcaccacttgaacacttgcagccagctcatgacagcatttaaagtgtctttgctgatttgttgaaaacaagatgtaaaaatcactcagtgagaaggtggtatagaccatcagcctaactccaatcctgctcgggcttcacctcccacctcccggctcacgtgccctcgcagcaaacttctcattgctcctcaatttatctccagccccagttcctctgttgaatatcttctgccccatcattgcccctgttttctaagaaccagctcaaacatcaccacctcggtggagattccctcctcctggggttcacccaggaaactccaaccaggaagcaggaggtgggattccttggatgaagaagaggtgagtgagtccccctatgatgtgagctagtgaagggttgtcatcagctcagagtcattccaaaatactcttaatacatttctgttttcattgtatctttaggaattagtggcgatgtttatgccattgcagaaaaaaaaagaatgatgctccatttcacagcttacagagctggtttcacatacacttgaatggtccagctatttctgacagctacaaaacacaggcgcacacaccaccttgccttctgggaagctgtaggagacacattacctcttgacaggataaacagccacacattagagggtaaaggcagggcaagcttcaccccagcacctcctaacctggcacaggcttgaccacatgctacttcaatgacttctttttgagatcaaacacctgcccagcaccccagtctcctgacttcttgcttggagcctgcatctcagcttcctcagcagcaatgaaaaaggaagccaaccccgacctgtagaaatagtgtatttcctcaattccaaggcacacaattgttcaaattttaattattctgaaatcaggatgtgtcttacaattagtcggtacactacatgtggggtttcttttttctttcgtttttgttcaccccctacaagctgttcttaaaacaatggtgtgtcatacaattgatgacatcttagaatcaaataaaataatagttaaaatcatggggtggcaatttaaggtccacccgtgtcagacttctcgaagtcattgtgaaactgtgttttgttctgctttgaatgtctggtggtgtgaacccagagagactggattcctagatccctgaggcctcctggccgagccaggagcatggggcagacaaagggcaaagcatggtccctaccgacttgtcaggcctgccagccctgccactggctttgtgattttcattcctgaattcatagagatggctgccagcaacgagaggtaatctcaggacacacaggcctgggctaggccttggaatattccggaagtcggtggccagagttgtatcaagccagacgggacacatatgggaatacaattacagcaaagcctgcaaggctcagtgaggggcagagggcctggccacatgaggagccagtgctgtgggcaggcctgggtctgagtgccagctgtgtgtcctgcacaaccacatctcccagagtgcattcgtcaccatccactccagatgccccttgaacaaatgaatttcacagttgcaaaaggctgaaaaatgctctgtgacctggcacccccttggggaaccacagtgcattaaaggctctgagaagtcctgcagtaaagaaacctgatgaacttttgtttaagttaatgttttccaaacttctttgatcacagaatccttttattccagtaacaccttttacaatcttaagatgtgaattttctgcagaacagccacctgggaacaggcctgtcttgtgcagaagcctgagggactgggagccaatctcatcactccctcacttgattatggaaagatgaaaacagagagtggagaaatgaagggtaagaccagggaagagattctctctggggtcccaaaacatggccctggctatggacatacttgggggtggggggatccacttgcctgctggcctcttttgggcagttggtattggttgcccgggtatccccggggcagtagctgcagcagtggcctgatgggtgtgcaagcagctagctggtgtgtccagcacggtcttggcacacctggttgttttggaaaggtcttttcttgaacaggaacttgcatactcaaaaacaacagcaaaacacaaggccacactcaccccccaagggtaagtccgtggctcctcctgcacacccaggaaagatcccgtggaaacacagcaccggaggatatgggataagagacaacagagaggagtggtgcttcctgaatttaggaaacatagctgctactttgggccctctagatacttgaaagaaaaaatgatggaaatcactaggtgagaattaagttcttggtgaccactggctgtatgcaggacaaatagtactacaaagtactacaaagaatgcaaatctgtctgctgcacccagcaacttccagttggtaaaaggctatgtccctggagaggtaataactgccactgtaagaaattcctagggtccaatcctgaatccttctctcaacagcaggattctgggaaagggaagccaggttgttcatggacattcagtggaagaattaaggcaattaaatgttaagttttgcagggctggtcgacaagagaagaagggaatcataggtaatgagcacaactaaaatgaaggcacagaagcaagacggtcaggctttgctcagagaataacttcaatgagagcagtgagcaggtgctccagggtcctgggagacagtgggaggtgggtcacagagagcaggctgaggagtttggatctgctcatagagaaatatcttaaactaacagattccacgtcaggcaaggtctcttggcttcaaggagctggcagtcaggagggagcgatctaatgctgggtgggggttgagagcatctggtggaaagagggaggatgtgggcaaagagtttttccataggtggtgtggttgtccgaggggaggccatgaacagagagaactgaggcagggagagggaagcccacaggccttggggttgggtcagaggaggtggtcaaggagggaaaggaaggagagaagacaaggagaaaggaggggaagagggaggcacctcccctctcactggtgtcaggattcagattgtgactgggctttgcatagagcaggtgggcagctgtgacccacacatgatattccacccgaagatgtgtttttctgacatgcacagtaattttcaaaagcaggaaaactttatatagatatctagatttctctagataagtggaaaggcctggccttcctggacctgcacctggcagtgccacctggagctggtcacagctgctcccacaactcctggactgggcgcttcagttggctgtagtccccacccttcctactgcctcacacccaggtgacttcactcacgtccactgacaccgtctgcctgtccccaaggacactgaagtttgcaacctaggtgcagattatgtgcacacagggctgccattcacaggagggagatggtcagtggggtaggagggcgctgaaatccagcttgcatgcatgcccatgttctctgtatgtcccagggaaggaggtcccttctgtatttgcacaaagacatcgtactggctgaaaatggccctgcccgcaaattctcccaaaggtgtgtattctccattggtcacaatgcactatgtagcccatgagaaggagaccaactccggggagctgagagtgagaggagactgcattctcagacacaattgtccagacacttcctttaaaaactacacgccaatgcccaataatgctcagccttggaaaacagtgagtgtctaatcaagccatttaaagcagggagaagattttaattggttgcaagggctggtgtaattatttacagcatacagaggttttccttttgaacctcacagcaatcaagtgcagcagcaatttttctttccctattttgcagatgaggaaatggaagcttatggaggttaagtgattggcctcaggccattgcatttaatactactaataatattaacagccatagtccatcctgggcaggcctgagcatctcacacacatttgctcatttcctcctcaccccatgagagcactgatgctactttttcctctctcccagaagaagacagaggcctagaagagtctgggcagactccaaagcccacccttctagtcccaatgtgagacacccccattaataacaccaaagggcccacacctaaaggcaaatcagtcaactaaaatccaggtctttggtctagaatctgtcactcttattcctgcataatttttaacactggactcatggtgccttgagctgaaatggttcatgcaggatatatcaaaaatctgagcattaaccagagtgtttgtaatgacaaggaatctgtgccttttctatgagacataccagctctgtgtttgactctggtcagtgtaggcgttaacttctgatctgaatcagcaagacctgggttccagccttgccctgcaacccaccagtggtgtggccttggacccatcgcctgcctgtcaaggcctcatcttcttcctctgggacaagggcacagccacagcccccgtgttatggcaacacatgggtcaggctcaggtctggcgcttggcaatcagctgatgatggcagggaggctctgcttcctgtcccaggcagaggggatggcacggcctgtgagtaatgcaggtttgagtggtgagccagttcagagcaaggctgggaggacctttgggcacagtcaggctccagggatgcaaggcgtggctccttcaacttgtctccagcacagccacacacgccaccagtgtggggagggagcccctggtcattttctgctggggagcagaatcgctgatgaagggcccagcgccagtggggaagaggcctccccaacaaccctgggcctcctgcccgctcaagccacttaaaaatccgtaccgtgcccacaaggctttccagtctccatgtctcaggaaggtccaagacagtaggtggaggtgggcacatgacagggctttctcattgcctccaaacaatgccatgtgctaggccatattttctgctcttctagaagcttctgtgtcctgggccaggtgggtgctcattgtgttccctctgtctctgggatcccctcctgctcaggatttagggggattgggtgccctgtgcccacctgccagctcccatttactcacaccaccctgcaggctggaggcttagccacttctcaggaggagcctagaaaggatattggtcgcccagctgctgaacctgccccagcatccttgagggtcttgaaaaatctattttatgctgggcacctgtaatcccagaaatttgggaggccgagacgggtggatcacctgagatcaggagttcgagactagcctggccaaaatggtgaaaccccatctctactaaaaatacaaaactagccaggcatgttggagcatgcctataatcccagctactcaagaggctgaggcaggagaattgcttgaacctgggaggcagaggttgcagtgagcgtgagccgagattgcgccgttgcactccagcccgggcaacagagcaagactccatctcaagaaaaagaaaatcttaaaaaaagaatgccactgtcatgtggaaacacctctaacaaacatgaggccagctaagctggggtgggggccaggtggcagcctctgaggaggcctctgcagtcctgggtggatggttcgggtacagcctgtgaatatgagaagctcttggccactgcacatggctcagttcccatcatcgtgcatcagacactggaagacagtagttggagctgctggacagggctgttttttctcaaccagacagtatccaggtgcctgtccctcagcagagggagaggtgccacaaccggctaccatgataaggagtcagctcagagcacctttgttggggggcctgaggagatgaggtggtatggggataggattctggaggaccctgctggaacaggtagaaggacaagaataactccccactgggactggaggagaggaaggcacatgggggcccttggcagggtggagtagggccataggtaaaaggaaagaggagaaaaggacagatactggggagagtgagagggaagggaggggaggagaagggaggcggacacctccagatctggcatggcagaagtctcctcggaaaagatgagtgcaagatgtgggaggaagagtaggacgtgagggtctccaaagtctgctcgaattttcaggtacaaatgacctcccatcagaatagccccaatctgagttctgcagaggctgagagccaactcaagggcatggagtttctgaagccagaagggaccttgataaacaagaaagcctgaggcccaaggaagttaaagtgatgtgctgaagataacccagccaaaagggggcgcagcctggatccacacacttcatggtgctctacccactacaccataaaaggagagtccaaacatggtaaagatggatggcagactggcagccagtgctgtctccatgacagcactgtcatggagattgacattgacattgacattgacattgtcatggagatttacactgtcatttacaacctggcatgctttagatggtaaagtaataaagcagaattgatgtgtctaaacaaagacctccagtaccttggaaaactgcacacctttgtttagcaattgcgttcacatttagtaattgttttctgagtaatccattcatcattcatttattcctatgtctggtattggcaatttaaaaataaacacaacagaactcccactgtataattgctaaacacaatgacagctataattgaggcactgaaggaaggtcaggggagcccaggagggcggggctgctgctgcctgctgagctgggagggttggtggcaccccttgccctgggttgccatagcagatatcataatcaattacggccgtctttcatgaggaacctggatctttcccaaggaatcagtgagaagtttcagctcacataccatctctgatttgccatccctgggatgttagctgaatcctctcattttacatggaggagactgagggccacagagttcaatgcagggcctagtttagactccagaccagctgccaagagagatgaagggctggtggagaccagccagcaagtggccatgccgcccgctgcagaccccacttcacactctcatgccacccccttgggttcactgacaaaattatgctcacaaaagcagtgctctgatttctatgagatactgtagaaaataacttgttttttctttttgtattactttttattgtatgatacatattcatttcagaaaaactagaaaatacagctaaattggaagggaaaattaaagtcactcataatctaaccactgctatttacatttataccttattggatatattttcaatatctttctaggcatttttctctctgcttatgtgcctgtggtgttatgatacatatgcataggttttcattcatggttcctggctcatcactctcatagtccttgttataatgttgggagcgttaggcctcaggagacaacgtccctctctctgagtttttcctgttctcctttctcctgcccaaggcgggactctaatccgattgtgggtcaaaagaccttcatttcagagcaggtcctgccccagcccctaaaggaagaaatgctgcacagagaggctaggaaaagtctgaacgggcaggtcttgctgggtttagattgtgttctttttgcccaatcacatttctacatggttgtcagtcatgccatgtaatgaaggctccataaaaacccaagacgggccaggtatgttggctcacaccagtaatcccggcactttgggaggccaaggtgggtggatcactttagcccaggagttcaagaccaacctgggcaacatggcaaaaccccatctccaccaaaagaaatacaaaaattagctgggcatgatggcttgtgcctgtggtcccagctgctcaggaggatcgcttgaacctgggaggtgggggttgcagtgagctgagattgtgccactgcactccagcctgagtgacagagcaagagagagagagagaaataaagaaagaaagagagaaagagaaagagaaagaaaaggaaaggaaaataaaaggaaagaaaggacaggaaaagaaaggaggaaggaaagaaagaaggaaagaaaagaaaaagaaagagaaaggaaaagaaaaaagaaaaggaaacgaaaggaagggaaaaggaaagaagaaggaaagaggaaggaaggaaggaaggcaggaaggaagggagagaaaacccaagaggacagtgttcagagagctgagcacgtggagacagactggaaggtggagtagtcatccatgtgccgagtgggtggctgccccagctccacgaggaccagactcttccagaccttgccctgtgtatctcttcatctggctgtttatttgtatcctttaaaatatctttctaacaaacctataattgttaagtgtttacccaagttctgtgagctactctagcaaatggaatccaaagagggggtcttgggaaccccagcttgaagtgggtcagtcagaagttccaaagacctggacttgagactggtggaaagtgggaggcagtcttgtgggactgagctcttaagttgtgggatctgatgctatctcctggtaggcagtgatggaagggaattggaggacacccagctggtgtccactgcttggtgtgtggggaaaatccccacacatttggtcacagaagccttcttctgttgttgattgctgttgcagtgtgagagcagaggaaaaacatgatttgagaggtttttccaaaatggttcctgagtggtaatcacagtaatccatccaccttgtgagtgtgcatgcatgcttatgtatgtgtatatgggattacataaatatggctcacatgtgtatgatcgtatttgcacactcccttgtccacttacttatatatcaaagtttccctcataatgtctgttctgtgtcactatgtaccctcccctgtcctccattccccacaccaagagtattatgagtattaaatgccacgtgggcaggttccccaggcaatgagggggtgggcctgtcaaatgcaggccatgcagaatgccacagggcgggagacgggtgagccaagggagccgagagttccagataacagagtgcacagcaaatgccatggcccgcgtccagcaaccaggagaaacagaactgctgagctcagaataggccaaggccgtgtctgctagcagggagcaagggcacagcctgctgtctggcctcttctgccccatccctccactgggacatggcccagatgagaaagagctgccagacggcaagtcaagtgtggggcgggagaggacaacgttttatgcaagagtggattctcggagcctctgcactctccatcagggctgctggcatggaaaacacagagaaaccatcacctaggacttgattgaactactggacttcccagaagagtccaatttaaagcaaagaggtccagagaaaaaagcattctagtgacatttttatatatttaaaaactggaaaaaagaaaaaataattagaacactgagttcccactgtctatgaaaaatgggcccagccccactgacaaccaacacgcctcacctcacaccttcccctccgccttcgttctggccgtgagccctgagccgaccatgcacatcttaccacctggagaacctcaaactctcctcttgcccacccccaccaagccccacattcaaaaggcttgcctgagaggcctgcccacttccttggcagttctggcctccagtgccctggcaggtgagtgacttctctgtcctgtgtagcatttggtacaggtatgtactgcatttataacacttaccatactggcttggggttgtgacacatcttcaagggagtccctggagagcagaaagcttgtcctattcatgttttgcccatcttgttcctgaataatacctgcacattgcaagggatcagcaatatttccaaccaaaccataaacttctccatctccccttgaagtcttctcgataactttcccagaaactcccagaaacaacaatggctgtcactcactgagaccctcctatgcgttaggccctaggccctgtgccaagccttggcattcacgtgtcacttaaacttcaggtagattgtcagatttagcaaaaacaataataaataataatttaggatatccagttagatttgaatctcagataagcaacaaataatattttagtataagtatgtcccatacaacttttataccaggcatcctatattttatctggaaatcctggccccagggcaaccctacgtgagaaacttgtaggtccattttacatgtgaaggaactgaggctcggagaggttaaacaactttcccacggtaacacctgagatggaatggcaggcagctgacttcagagtcccccaacacggcctttgcttgtctgggagagggagctccaggtggaactggtaaagggggtgaatccattggctgggagatgtcatgagtttgagactatattgggagcacccggcacatggtggccatcaagcaatttttagtctctctctcccttccttcccttgcgccaaattggaaattcccttgagaccctcacacggagtcctctacaaacacattgaatttcagccctcataggaaagcagaaggaagaaggatgatgttgcagaagatcgctgccatttgatttattacaacagtctgaggcctcagagagcgcagagcaaagagaccctggaatgcagccccagatccctggaagagactttacaggtgtcacgttggagagtggagagtgagggggatggtctcaaagaacaggagcagagattatcagagacaccacaaacttgaaaagtcaggatgggtaggacttgaggagaaaaaaaaatcttacctttacaatagcttcaaggaccacaaatttaagggctctccagaggctttaggacagagtcaaggaagtgcttcctggtcgaccctttcaacaaaaactgtgcccctggtctcactgctgcaggcagtgatggtggtgtcaacatctgctcttctcgggctccctccacgcctctgaaaacatggaagtgcttttacccatccagaaagaggggcagctgaaggaaggaggaaagggggtggtccagcgcaggcgcagcctgttgggaaccttctgctctgtctgagcatttgtgatggttgaatgggctggcacgggcgtctaaggcaaggaactgcaagggaggctgcagcctgccctcgtgacccagcactcgtcagatggccggagtgggaatgcgtcagagatttgcctttggacagaactgaaaggatatgaagcagggatgagagaagttctttccataaaaatctgaaaaccaaagggccaaactgatcaacttgcagaacgggaaggactgacaaaaatctcaggaaatcaccaaggtcacaggggaagatcatgaggaaaatgtatgtgaggctcccagcccagccctgccaccacacagtgttggccctgactgccactcacctgggtgccccctggactgcaagcacctggcaggggctgggctttattcctgaaacagtagggggtcctatagcacagcaccaggagaatatatagcaatggatgtccaccccatcctgcaaagtcctgctcaagggccagcccccacatccccagctagaagccgcctctccttctgcaacgttctactgcggctctccacctctcttgggactggaagtgagaagcatttttcacggtggttcacaaggtctcagtgcagatggaaaacagagagtaggtgagttggagagggtggcacagactgaaccccagacaagaaggctgcctggggactcagccctggtctgttagcagttacgggtacccagagcaggaaagcaatgcagaagggtcactttaccccaggccccacctggagcccagctggggctgtccacctgcttcttcatttgtctttcctcccagatccacatcctcgcctcacatcaggaaggcccagtgctcacttttacccaccatccgcctcctcccagttgggcgagtagccctggctgctgcacagggtgcctcccgtatgccaggcactctgctggctgcagggcagcttaacctgcagggcggtcaggacagacagaatctttgctttttcttttcatctgatcagggacttctgtctgatcagaattaggtgtctgggctgtcccaggcaatgcacgacagtcactgggctctcctctcgaagattaaccctttccagatggccacaatggtggcggcagccaagcgcccacctccacataagtcttccctcttctgtccaagccaaatccactcacaggaaaggatctggaactacatggagctaaggagtaataactagagacagttcactaggatctcgtgtggagcaggaaatcaaagttggggactgcatcacactgctgcaatccctattaaacatttgttgttcaaagttctttctcaatggcctgctggaattttttttcattcttcctctttggcctgtcttccagcagtagcaccagcctccccagcttctcccgtctcctcctggacttcctcatagctgtaggcttccatgttctcaactctattattcagaggagttcagctcagtcacgtctgcgccagagctttgatgacccacctgtcagccacactaagggccctgccatgaataaggcctccgtcactgaggatcctgtacccctctgccataaactcagtgacctgactgccagccaccaggcagaacctactagacttctctaaaatagataccgtggcctccttcctcaatcatagtcaaggtctaagcttccttatcaaaggcaggcagtcctgggttttacggcaagaagtgtgcttcctatgtgcaaggtgctgtggggaagggctgagtgtggaggccatgtgtgcaggtctttaggattttagctgagctgccttttcttgcagtttaagaaaaaaacagccagccgttccctccttgtaataaatgcctctgcatatttgaagacagtagttaggtcattcttgagctttctcatcttcaaactaaacaacagtggcccctgtaacctttccttggcaaattgtaaggcccatatgcagaggaaaagcaaaacaaaaccatctgatggggaaggcctcctatctctaaccaagtgtctgttttgaaatgcggtctgcactcagtctttaattacatgtaaattcagtagcttcaagtgtctgagccagtgggagaccaggtgctgctcatcaggccccttggatatgttcatgctgcaaggctgggtgatagcacttggcagacgctaggatttcttctcttcagattcattttggggcaggaaaaggggcttccgtgagtgacccaggagcagtcagctgacacttcctccccaggttccctgagggtaggatgggccccaagagcctccagagagcctgtggcctgctggaaaggctgccctctgcctccacagaagccagcaagagtggcttccagatgtccctggtggaggctggcagcctcatcctgcagccagcgtctcccaggggaggcttcctgctgctgctaactcagagacaggggatctgctaagcgcctgccctcggtgggggtgttctgatcacatcaacttctttcccatggttctttccaggctcctttcccacatttgcagtgtgttatcttgggagaccccatgtgttagtctgtttgtgttgctgggaatacctgaatctgggtaattcttttttttttttttttttttttttttttttttttttttagacggagtctcgctctgtcacccaggctggagtgcagtggtgccatcttggctcactgcaagcgccaactcccgggttcacaccattctcctgcctcagcctcctgagtagctgggactacaggtgcccgccactacgccaggctaatttgagtctgtgtaattcttaaagaaaagaggtttatttggctcatagttctgtaggctatagaagaagcatggtgctgggcacagtggctcatgcttgtaatcccagcactttgggaagctaaggtgggtggataacgaggccagtagttcaagaccaacctggccaagatgacgaaacgccatctctactaaaaatacaaaaaattagctgggcttggcggcaggcacctgtaatcccagctactcgggaggctgaggcagagaattgcttgaacccagaaggtggagcttgcagtgagccaggatcgtgccactgcactccagcctgggcaacagagcgagactccataaaaaaaaaaaaaaaaaaaaaaaagaagaagaagaagaagcatggccaccggcatctgcttctggtaaggactcaggaagatttcactcatgaccagtcatggtcaaaggggagcaggcatgttacatgtgagagagagagcaacagagagaaggatggaggtgccagattaaaaaaatccaatcttgcagaaataagtagagcaagactccgtaccgtggggacggcaccaggcccctcatgagggatcctcctccatgacccaaacacctcccactagggcccacctccaggacccactggagatcccatttcaatatgagatttggggtgaatgaacatccaaactgtatcatccaaggtcagtgcgtttctctgtcctccagttttgcctgccatgagcagctttcctgtgagccagctgtccttttcgtctccagggtcattttcttccttcagtgcccagtgtttggactttaggctgaccttcaggattgtggagtcacagaacaagctcatataagtgtgtaagcaggcagcaaattttttaaaataaagaaaaagttatttagactgtgccagtcagtctgtgtgccatcctagctacaacccagggtggatgctgagtggagggtagaggagtgcatccctcactcttatctgtgcttgtccttcttgcatactgctgaggccaggagcacctagatttgccccagtgggactcacctttttatttatttttatttttatttttatttttatttttatttgagatggagtctcactctgtcacccaggctggagtgcagtggtgcgatcttggctcactgcaacctccacctcccgggttcaagcaattctcctggctcagccccctgagtagctgagattacaggcgtgcatcaccacgcccagctaatttttgtatttttagtagagacggggtttcaccatgttggtcaggctggtctcgaactcctgacctcgtgatccacccacctcggcctcccaaagtgctgggattacaggcatgagccgccatgcctgacctggactcacctttgaggagacacggttttggccaaaatagctgttaagtacaagtgttcaactggtgcccaaccaaagggaaagcaatcttttccaacagtgaagaagaaattggttgtgtctgcttttcaacagcaagggggtgagtctcaaatatggtgcctccattaaggtgttcaataatttcaactacatgaaaaatgtgccttgggaatgacttcagaacttaaccctccagggagaaatgcctctactgtatggcccctggcctggtctcagattggatcataagctccctcattcttgtatccccatgcccaaaactgtgcctggcacttaagggcccataatacatatttttggctttgttgaatagtttaactcattagtgatgcaaagtcccaactgcatatttagagatatttatgtgtgcactacattatggatcgtatgggtgagaagtaggaactcaaagagaataaatcatactttccctccccaaaatgtttataaagccaccaagaagacaggacatagacacatcaaatataaataaaatacaaaaggatgcaccctgacatgccaaatatgtgttcacagaaacaaagttcctcttgccaaattcctgttgtctaaagcagtttttcctaaaacatattcttcagaataccagtttctcagagtgccaatgtgaggaaaagctttggtggtcagatgagtgcagggctgggttaggctgatttctttaccagagggcttcctgaagacttaaagaaatctgtattgagatataatttgtatagcataaagttcacccactttaagtaaacaactcattggcttttagtatagagttgtgtatccatcaccacaatgtcactgcagaatgtttccatcaccacccaaaacacctcatgctgtttgcagccatttcccatccacttccttcctagcccctgacaaccactaatttaccttctgcctctatagatttgcctattctggacatttcatacagatggactcatttactgtgtgatcttttgcgaccagcttctttcatttaacttaatgttttcaaggttcatccacattgttgcatgtatgcactgatggacatttgggttgtttccactttttggctatcataaataacgtcattataaacattcatgagcaagttgtatttgaccatatgttttcagttctcttgggtctatacagaggagtggaattgctgggtcatatggtaattctacattgagcttttagaggaactcccagactcttttccaaagcaggtgcactattttgcattcccaccagcagtgtacacgagttccagtttccctacattctcaccaacacttattattgtctgtccttttttattatagccatcccagtgggtatgaagtaggtatgaagtagtacctaattgtgattgtgattttgatttttgtttccctaatgactagttgttttgagcatttttcatgggttcagggcctttgatatgttgattttttcacaaatcttcaaaaggggacacagtcggcagcagttcctaaatgcgttggaccatggagccaaacttgcaaaagcagctcctggaatgcaagcgcgtacccaaaagctgggaaacattggctggaaaccagcctgtgctggaaatgtgagtttggtgaatgtccttaggtcattacttctgcaaattttgctcaaagaaagggaatctgaactctccacttttgtacattaagataataataataataataattttatcccaagatatggcaccctggcatgatgaatattttgaattaaaggcccttggagacaagcagatgctggaaaaggcttttggttatctgtataaagattggacccaccaaggacagcaattgctttccatctgttccctgaaatctcgtacctggatggaccttttcacaagataatgtctgtttctcaggctcattaaaattcaaaagagaataattaacaggttagtttctgtcccccctcccccaccatctattcattctcactaatactcatttgttgcccctaacaagaattacctacattccccacctcctctctttcctatgaggccttgctgaaggtcaccactgtgcctttacactcaccccccttcctttccctactgcttacctgccccacaagccagtcatggcctctcctctgagccctgtgagaattcttagaggttttatcctcagtataattcaaatgtgttcccttctccaatacccaaaaacatggtatgggattattttttcagtaaggagacaaatagaaaggaggccattcaggtcttctatattttaagaccacaatcttgactgaacctataggtgacccagtgtgcataagctgctatttcctgtcctcctagtcatctttgtgtagaatcaaagacacccacctccttggtacctctcatttgtcacttttcaacacttcctggcaggcaggcagcataactggtcctgctgggtgatccagaccacactctgcaactctttcttctgagccaggctcccctactgtcttttcatttatgtcaaggcaggggaagacctcaaagggctcttgcatcccagtcccacttcccagagaggcacgaggccctccaggatgtggggacaggaactttggggcaagccggggttgtccagaagatcaccaggagggctaaatagtagaaaggagagtcttattggtgatatgtttgcaaactgggaaaagatagcctccagtgtggagcaaagatgctccctcttcaaagagggcaagggcagcttggattttgtgccttacagggtcggtattatataatagagtcatgcatattcagtaggtttggggggaaagctatatatatttatgaggggagccaactacatgggcaatggataaacatacatgtaacacatcccatgttcacttaggggcaggattttagcattaaaatgaggtggaatttggctctttacatcaaaaggtgagctatcagacacaaaggcagtttgtgcacaagctctccaaagggacttgagggctacagctgctcatctggaaagaatccttgtaagaccagtcctctgtccaaccagagttaggaggcgtctgacaatttgcctgattagctctactgttgggagtttaacaagggtgtggtttttcttgtaaccataggaatttagggagttgccacgccagccaagccctaaaccctgggcttataggtaactttttccctaaccttaagatctgtcttagttggtaaaggggtgtctattttggtctctcagatcacactagaaacctctcaagtcctgtattcttattataaagctgattataaagctttacaatttactttgtgattactgtagcttatcgtaaagcaactgtaatcagtaggattggtgtcaagatgggtacacagatgggtagaaaagaattgagaatccagaaatagactcatatttacatggtcaatttatttttgacaaaggcaccaaagaaatttagcatagaaagtataatcttcatcaaatgatgctggaaaaattgagtaactatatgcaaaaaagaaagaaaagaaagaaaaaagtgaaaacctccacctccgtcattacttcataccatataaaaaattaactcagaatagatcatagacataaatgtaatagctaaaactataaaactcctaaaagaaaacaggagaaaatagagaaaaccttggtgatcttggttttggcagtgatctgttaaattcaatagataaaacacaaattagaaataaggtattgactgaacctcataaaaataaaacataaacttttgttcttcaaaagacatttaggaaaatgaaaaggaaagccccagactgaggtaaaatatttgcaaaacatatatataataaaggttttgtatccagaatgtataaagaagttaagaagaaaagcaacatactttttttttagttgacaaaagatctgaaaaagacatctcaccaagtcgtttgtaggactggcaaataagtaaacaagaagaggcccaacacctttagtcattagagaaatgaaaactacaaccacagtgagataataacacccactagaatggatgaaattgaaaagtctgaccatatcaagtgtttgcaaggatgtggaaccaacaggaactccattcacagctagtgggaatggaaaatggtttgaccatgctgaagagcattttgttgtttttttaaaagttaaaaatatatctaccatatgactcagtcattccacacttggttatttacaccccacaaaaaatgaaagcatatattcacacaaaggcttttaaacaagtgttcataatagctttatttgtaattgccaaaaaccgaaaatcacccagttgtaccccagcaggtgaatggataaaccaattgtgacgtagtcatataatggaatgctaaccaataatttaaaaaaggaacaattgatacctataacagcattattgaatccaatagaatgatgctgaataaaagaacatggacaaagaaagagcacatactatatgattttagttacataaaattctaggaagtgtactaatctatagtaacagcaagcagatcagtatttgcctattgggggaaggagtcggacagcagcaggggaagggttaaagtcacattttagttttaaaatattcagcatgtattttgggctacaaaatagcacaaggaaactcttgggtgtgatggacatgttcattatttaattgttatgatagtttcagagacataaacataaaaaacttctcaaatacacacttccattatgtacaatttattatgtggccattatacttcaataaaactgtcacggaagaacgacccttatcttctggaggtacatgctgaatgtcttacaaataaaattatctaagaactgaaattggcttcaaggtaaagcaggaatggggtgagaagtgtgtgtgacgtggacacaagggtgatatagaagattggcatcaagtgacagaagtagacggtagattcatttttatatatgtttgaaatactacattacaaaatgccagtagaaaatctgagtctaaccctaagaatgcagtacatcctgctgccatgtttctttctttagagctgaggagaggcctctttactttggtcggaaacctcattaggtttgatttagttcaataaaaatgtgtataggtgaaatagtccatacgaattcattacaattgatgtgaaacaaaattaattaataattaatccatgcaagtcttttggtagcctgcattttatcaaagaagggacccatggcaaaggctgggaagggacctttaacaggggagcatgagttccacggcagagttgccctcaagtaatgctttgtagattggtacagcacatgtgcatcaaagtagtgaaaggattatgaaatgtgaataaggagttagaaggtggaccttgaagtcctcctgggtacccatttccccaagagtgagcatcattattcttcattcccatacttctacaggatcaatgttgcagccacagtaggtggaaaattccaactctgctaacagttgggagcgtgtccctctaatgagaggacctgttcatgcaattttcttgatgtctggtgaacgctcccacattatatcttcaaaagactttactacctgagagggtttcatgctaactgctgagtaaaaccacccagtgctgagcacgcagagaagggagtggggatacaggtccaccacagcccaggctttggagtctgccaaagcagtcagacaacggtggtcagaaaaggtgtatgagtcactcgactgactacttaaatccaaaggaatttgtttacatggaccaatcgttttagtaagatggtttgttatgtgcctttataatttaacatattaattttatttagacaatattggaaaagataatgcaatccggtgatctcagcaaaattctctcctctataaaaataatgagaaaagtgacaaaaataatcagaatcaactttttagaactctggaaatttaccaaagtgttgcagccatccaaggattgtttgctcaagcaaaacaactgaatttcacctagaatagtgaggtttgtgacattttaacttgccccattcgcatcaccctttctccagcttcatggcagcctcgaaaaccagcagcccccagtcacagagaaaacccgtctagtggttctctgaaagaccccacttgcaaggctgtctttatttaatctgacttggagtttgcccagtgtgaaaagccatttcttcaggggcatttgttaaaaacatttagaggcaattgtttaacttcacagatgcttgagatagtggataatagttgcaacaaacaataggctaattaaaaagcttaaagtgaaaactggagaatggatgttcataggggctttgaaaagctctgacatattctgggaaatctggaaggccatgagcaggagtaagataggctttgcacatgcacagagctgtgtgcaggcttggaaaagatcttagaaggtcctaaaccctcgtcaatggctcccttaaagttctggacaagaagatattgtcaaaatctaagtttaaggtggaattgtcaactgcttggatgagtgtggaagacattccccaacatgcatgtagagcacctcagcaaaaacttggagatgtaaaccaaaaagaaaaatctaaggtcgtcctaccccaaccatctgaatggaaccctcctctctgtcaagggcattccaaagtttacctgaaaaagaagttcaggccatgatgggaaggcagagctggacaaacctggtaataccctcctcctttctggagttactaacagaacagactctaaatctgataagaaacatttacaatctagtctgtctgaagcctgctacctggaggcttcatttgcatgacaaaatcttggtttccacaacctcttatcataacccagatattcctttctattgatagtaactctttcaaccaattaccaatcagaaaacctttgaatccgcctatgatatggaaacccccacttccacttgtcccaccttcctggactgaaccaatatacatcttccatgtattgattgatgccttatgtctccctaaaatatgtcacaccaagttgttacccaaccactttgggcccatgttctcaggatctcctaaatgctgtgtcatgggccattggccactcatatttggctcagaataaatctcttcaaatattttacatagtataactctttttcattgacagagacttactagttcctgatccttaaagaaatttctctccaatcattagatgaccattaaactaacaaagcagagacgtcagtggctacacaagacaaagaatacagacttataacacaattacatcagaaaagttactaaaaaacaaaaacaccaacaaactgtaaaaacaacataacctgaggagtagagaaagaatctgattttttaaagttgccacattgcatttttaatgtccagttttaacagaaaattacaagacatgtaaggaaacaagaaaatatgtctcatacacaggacaaaatcgattaatagaaactgttccagaggaagcccagacataaaacttattagaaaaagtctttaaatttagttcaaagggttaaagaaaaccatatctaaataactaaaggaaaggatgaaaatggtgtttatctaacacagaatatcagtaaagagatagaaatgataaaaaaaaaaaagaatcaaataggaatgctagagttaaaaagataactaaaaggaaaattttaagaggagctcaacagcagatttgatcaggtggaagatataatcagcaatcttgaacattgttcatttgagattttccagactgagaaacagaaagaaaaaaaaattatgaagaaaaatgaacagaacctcagaaacctgtagatctctatgcttgtttttctcaggtttgtcaaagatcagatagttgtaggtaagcggcgttatttctgagggctctgttctgttccattgatctatatctctgttttggtaccagtaccatgctgttttggttactgtagccttgtagtgtagtttgaagtcagatagtgtgatgcctccagctttgttcttttggcttaggattgacttggcgatgcaggctcttttttggttccatatgaactttaaagtagttttttccaattctgtgaagaaagtcattggtagcttgacggggatggcattgaatctgtaaattaccttaggcagtatggccattttcacgatattgattcttccaacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgctcttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgcaagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctgggagaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacactttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcgaaggacatgaacagacacttctcaaaagaagacacttatgcagccaaaaaacacatgaaaaaatgctcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttttcaaaaaaaaaaaaattttgtctctaaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttctgaatcctttaagttgatcagttgacaggaatgcatttatgatttttatcttttcttttggggttacttttcagtttgactttgaaggatcactttcccctgtcattgcgcccaaaaaagccttccgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggttttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttcttttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccactgcacccggcccagttttttcttttatggttagttctttctgtatctagtccaagaatttttaatttagaataacacactgtattaagccttataaaaacaccagtaaattccaagacctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaattgtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtaaatttgtttgtaggttagaaactgccaggaagtcctgagatgactgtcttttccatgatatcatatagggaccttgtaaatacgtttctgaaatctgccttctctgaaaactatggcatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgccttacttacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatttttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgcttttttttttttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccatgcctggctaatttttctgtatttttattagagacgaggtttaatcgtgttacataggatggtcttgatctcctgacctcatgatccacccacctcggcctcccaaagtgctgggattacggcgtgagccactgcgccaggccgccaaggatgcttttaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttgggacccagttgttggaacagagctgaatcctggatgtttcttttgtttttttcacctttagggttagggcaaaatttttggttagattcttcttcttcttctttttttttttttttttttttgagacagggtctcactctgtcacccagatgggagtgcagtggtacgatcttggctcactgcatcctctgccttccaggctcaagcgattctcctgcctcagcctcccaagtgcctgggattgcctgggcttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtactgtggcagaaaacatgaagcattttggagaatatggaaaaacgttattccttttttttttttttttttttgagacacagtctcgctctgtctcttaggcatgatcttggctcactgcaacctccacctcctgggttcaagtgattcttctgcctcagtctcccaagtaggtgggactacgggtgcgcaccaccaggcccagctaattttttttcgtatttttagtagagacggggtttcaccatattggccaggctgttctttaactcctgacctcatgatccacctgcttgggcctcccaaagtactggggttacaggcgtgagccactgcacccggctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttcttctgtgtatagttctgtgaatttcagtacgtgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgtcatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttctggtttctaccttgtcttgtctcgtcattctcttaatacatcaaagagcaaaagtgtttaattttgatgaagctagtttatctgtatttttctttaatggatgttgcttttagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctggttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcctgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtctttgccccctgcccttctttttctttactctacgttttgctctgcttcatggtgagaagtgcttcagagtccccccatggctccaaaacagacatacagaatgatgattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagactttttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtaacatgtatcaaaattacattgttttaaaggcagtattctatatagtattccattgtatggatataccacaatttatcatttcacctgatgatgggcatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttacttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatgtggagcaaccgaaactctcatacattactggtgggactgcaaaagtggcacagcactttggaaaactgtttggcagtttcttgtgaagttaaacatacacttatataagacaaattccaactccttggtatttacttaagagaaatgaaaacatatgcctacataaagacccgcatgtatgtgaatgtctttggggccaggcgcggtggcataatctcagcactttgggaggccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcaacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagatgtgaatgaatctcaaagacttatgctaagttaaagaagtagcacaaaaaagactacgtatcatatgattcatttacatgatattgtaggatagacaaaactgtagagcaagaaaacagatgaattgtttccagtgctgggtgtaggaggaaaggattgactacaaaaggaacgagggagctttttggtatgatgaaagtatactatattgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcaagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcagtttctgatgaatcctcacagtatttaaccagaataactgtaggtaagttggtgcaatgttgcctctggaatcaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatgcatatgcaggttctgcagggccaattgcaggacttgagcatgcacggatttgggtacacatggggtgtcctaaccagtcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagaggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctcctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaattaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaagatgaggatattatatgggatgtatgttaaaaagtaaagttttaatgaatattaaaagatgtttttgaagtcttatctaaagtatgttctaaatgaagtttctgacaggttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctcttttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcatgaacccgggaggaggagcttgcagtgagccgagattacaccactgcagtccatcctgggtgacagagcaagactccatctcaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtactaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccactttgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtcccgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaacattaatctgtatttgaatgtgattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaaatagtgaaaactggctgggtgtggtggcgcatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaaaacaaaaaaaagcttaataatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagattttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatctcggctcactgcaacctctgcctcccgcattcaagtgattctccagcctcagcctccccagtagctgggactacaggtgtgcaccactgcgtctggctagctaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccatgcctgctttggaaaacatattttctctgtgctagtatagtcatggcacatcagcctatatatcctcatgttcagcaagtgcacgttaactgcttttgaaattattattataataaatctgttactcaggtgctctcatcagatgttccttcaggtacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaactttaacaaaccacgtgtgttagcaaaatgtctttggcttttgaggacataattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccttgatacattataagactcacgtgcctatgacattccagagctattctcttgggacacttctgttttaaaattctctcctgttcttttatctgcttgtctctatcatctatcattcatctgtcactgttttctagttctctttactttttttatggtactgttttgaggggaaccatcacccacacttagccacaggctgctgaagatctgaattagttgtgatttccctattaactgtttcctctccacatgtacccagttattagtcacctgtgaataaaaagatggagtgacagaagttgagtttagagcataggatttatgagcatggcctctagagccaggcatggccatgctgtgctgggtgactttggttaaattactttacctcttgttgcctcagtttcttcatttgtaaaagtaggcatacttcatgggatggtgctgtgtatcaagtgaattatttttacatagcacttagaatactgctcaatacatagtaaagctcagtgcagtcagccattattattagtagagttcattgattctaagatgcaagttttttcactttttaatatctctgaaatcagttgtgtattttagtgaacaggcgtcatagtttaattggcagtgctttttctttcttagtttctcatgaaataatgatacatcttatcagtggcatcttatattcaggggatataatattgttctcattataattttgttacttgcgcaaagttgaagtgaattatgtgtaagatttcctctaaaaaaattctatgggttgcaacagactcttggctttgaattttcctgatcccaaattaatgttgcggttgtgttcccagagaatctttaagacagcaaaatttttctttccagttagctagaaaagcagttatgtgtgtccagttaaggagggagtatgcttatgaatagctttgtctgcagagaaaatgtttgtcagttgtcagcctctgaagggatatttctgtgtcttcagatatagcttgtataggtgtttcttagttataaatgccctacttccaaaatttctgttagttttttttaagtggctatatggaatgttaagctattttaacataggaagaagttgaagagtggtgtatgaatttcacagtagagccaacagaaaccattttaaccttgaacatacctgatacataatggtattagtcctataaatctagccatcatgtaagtgaaaccaatctgtatttcccttggagacaccatgaaatccattcacctctaacacaaggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttttttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttatacagtacaccttcttttgaaatacttacagatgatatttcaattgctctttgctttaaacattttcacatgttggtttttactttaattacagattgctccaattgtgtcagcgaactatggctcttcctgtaggacgaggaatgtttaccttgttttcgtaccatcctgttccaacagagccattgcctattcctaaattgaatctgactggtatgttaaattctgggctcaatgagaaaggaaaatgattaagtacatgcattaagtgtagttctttaaattagttaaaacaaaagaaatgctccctctatccccagtgatttaaaattttcctaatagctgctgtagtggttatcaaagctcaaatgccatgtgaaactaaactttgagagaagcagaatatagttcattactcatttttgctttttaatgaggtgatttcaagatctaaaaagtcacttggagaagttcagaaagatattattgataacgatgagacttgaattttaaataatcttaagtttaatatgtaaaaatatttagttttaaaatgtcttacgtcatagtttaaacagatgatcattgtataaatcaagaaatgtactaagcaaaaagagaaacaatggtcacttgcagtactcccactcttctgcatcactccttttaacattttagtatatatgtttactaagtttatttccacatatttataattttatatttgtttaattatcagaaaatttatatctattttagatttttttaaaaatttacagtgaacatccttttatatctagcaaataaatgtatgtgtttataattatgtgtatgtattgtatacatgtgtttttaatcaatacactcatttttatttgcttcagagtatttcattcagcggatataccatagtttatagaagcagcctggtattgttggaaattacagttttttggtattataaacattgttggggcgtattcgtcctgtgtatttaggctaaatgcttagaagtagaactcttaggacagcaagatgaatggttttaaggaacatgtcaaattgcctttctggctggcacaagtttttatttctgccatatataactgtagttatagtcttgattacaatgaattttatagtgcatgtccccctaatgctgatttgaatgtgttctaaaggtgacaattacatagttgaaattatcactgaaactctattatagtatatatggttttgtgaaacctatacaaaatgtatgtataatgtttgttgtagtagtgtatagtatatgtggtagcatataatgtataatttaatatatgataaatagtacataatatatgcaaacataattatacagtattttaaattgcatactttaaaaaatccagagttccactcagatttgtgaaaagcttgtgctttgagcagcatgcaggaaatgagattgactaagtgaaagaacacattcccatctccataccatgcttattctgagccctaatctcactgagggacatagtgagcagagtggcttttaatatttaaattgtctcagaggtaaagcacctatggcaaaattttaacaattattgattcttgatggaaggcatggtatatagatgttcattttagtagtctttccaactgtttatatgaaagatttcatatactaagtgcagattaaaaagaaaatctaatgcaaaattggcaaatgttaaaatgtattcaatctgggtgatttagcactcaagtgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtctcttgcatatgatgaatgaatgtttcagaaaggtcactcagttttttcatattgatatgtctgccttttttgagaaagtacaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactttgcatctacttaaaattattttacataacatcttagaactctttaaaaatggtatttttaaagctgcagtgaaatggataactttatgcagtaattaaaatatttatgttaattattttatccgtgacttaagacaatattcaaaatatatttaaaaagattcaatgtttgctgtgtataatgtagatcaaaaagaaaagaatcaagaaaaaattcgtagggaacatatagcattgtgaacatataatttacattgttcttaaataaatggaccgtaaaagtataatctggtgaatgcccttttgaagttcactgggtgactcaagtctataaaaggatgctttttacaaaactatctctaagcattttaaacaatagcatataattagatatctatatctgtatgtatatatagagagagagagaaaaaaagagagcaaagggggcatatataggtaagacctgtagcagatttattaaggttcttgtttcctttttttttttcttttttgagatgcagtctctgtctgctgcccaggtgggagtgcaatggcatgatcttggctcactgcaacctctgccttccaggttcaagtgattctcttgattctctttagaaagtgataatctttctaaagcataaatcagagtacgtcacttccctggtcaaagccatttaattaatgatctcccattgctttttttttttttttttttttccttgagtaaggcagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaaccttagcctcccaagtagctgggacaggcacgcaccaccaggcctggcttttgtcttttcttaagatgtcatttttccttaatgtctaggggaaaataaaggatagaacatttgaaattaacatcagtgtcatcagatgttgggatttataacttgtatagtttaacagtgatgttagtcttcattttggtttttaagctctctgtttgaaagaaaaaatgagtgattatcccagtcatctctgtataatgttaaattggtatcagttatctcattatatagcctcatacattttaacaaaaaggacaatgaactgtttagacagtgaaggtttttccagttccattaagtttgactcacatgtacaaaagttttaagtggtcatagagacctaacgttccaggcattatggggttaatggttttgaatgtagaaaacgtaactaatcttagtctcaaagatctaaatttaacaatcttggttttgtggatttttattctctcaatgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaaggtgagacctgtgctcccagtgcctggctttgtgccttggctggctattgtagtagctcctaattgctctatttgctcttctttcttcattcttgtacttctaagtccatttgtctcatagtacatggaataatctttctaaagcataaatcagagtatgtcacttccctggtcaaagccatttaattaatgatctcccattgctttttttttttttttttttccctgagtaaggtagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgctttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatcttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccagggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaacattcccaacaccagagggcaaagggggatcgaccattgctcttaatatacattctaggagctggtgtgatcctgttcacttctccagccctaggtggtaccactgttcttcgttttttttttttgttttttttttgatgtggagtctcaccctgtcacctaggctggagtgcagtggtgtgatctcatctcactgcaacctctacctcccaggttcaagcaattctcctgcctcagccttctgagtagctgggattacaggtgcatactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttatttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctgtgggtttgccttttctggacctttcatatgaacggagtcatacaaaatatggtattttaggatgggcttctttcacttagcctgataattttagggttcatccgtgttgtaccatctatcagcaatacattcctttttattgttgaataaatgttttattttatgaatgtacattttattcataagttgatgaatatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaaccgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcttgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaaagtgatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatcctgctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattggctccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaataaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaattttttttttttttttgagagtcttgctctgttgcccagcctggagtacagtggtgcaatcttggctcattgcaagctccgcctcccgggttcacgccattctcctgcctcagccttccgagtagctgggactacaggcgcccgccactacgcctggctaattattttgtatttttagtagagacagggtttcatggtgttagccaggatagtctggatctcctgacctcgtgatccacctgtctcagcctcccaaagtgctgggattacaggcgtgagccaccgtgcccagcctaaaaattgtttttatagatcattgttataaatgggttttaaaacacattttgtataatattcattgagttgatggtctgtaaaatgcctttttttaacttttagaaccttttagattgtttctaataatcctttgttgttatgtataaacattacactgattacctttgtgtgtgatttttttctttaatttttattatttatttatttatttagagacagagtctcgctctgtcacccaggctggagcggagtggcgcgatctcggttcactgcagcctctgcctcccaggttcaagcaattctcctgcctcagcctaccaagtagctgggattacaggtgtctgtcagcatgcctggctaatttttgtagttttagtagagatgggatttctccatgtcagacaggctggtctcgaactcgttgacctcaagtgatccacctgccttggcctcccaaagtgctgggattacaggcaagggccaccacgcccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacatagtatttaacagcttaacaacgtaagtaagtgacctccttattcattatcatcattcgaacatgtttcaccacatgtgatgtgtggatttgaaagtaatgaaaacaaaatgtaagatattttgttgttgttgttgctgagatggtgtctcactctgtcgcccaggctggagtgcagtgacctgattttggctcactgcaacctccgcctcccaggttcaagcgattctcctgcctcagcctcctgagtagctgggattacaggcacctgccaccctggctaatttttgtatttttagtagagacagggtttcaccgtgttggccatctggtctccaactcctgacctcaagtgatccacctgcctcagcctcccaaagtgctgggattacaggcatgagccagcacacctggccgagatgttttaaaaaaaataataaaacttttttttgaatactcttaccttttttcctttaaaatttttttctactacttggtaatttttttgataagactcaaagtttcacagtatttcaatatcattgcttataaagacttaaattggcaatttaaaaagaactattttgggccctttttttttggtaggtaaacctacagttgtggacatcatttattatagtgtcataactttctgaatagttatatcccattcatatctccagtgcaacttgctagaaagttaactctaagatttttatgagatgagattttgagaagctagtttgaactgtgttgcttttctttttacaggacggcctcctggtcctgaaatggaatactgcactgacagaaagtcatactccttagctgctggcttggccctgggcatggtctgcttgggggtaagcatagcctatgccttcccatgcttcagttaggacatctacatgttgagacaaataacgttgacacctaaacctgaatattgtcccttactacgacttaatcttctgcccagctctcttgtctttttggatatttttcaaggtaccagatttgcaaattgagagaaactgtggtcaagagtgagactttaagatttcttttcctccagcttacagtgttcatgaacaaactaaagggaataaagttttttttaaagtgttcaagacatagaatgaataagtgacagcccactatgactgaaaacagagaatagtgaaaatgtatatgatcaggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagatcaggggttcgagaccaacctgaccaacatggagaaaccccatctctactaaaaatacagaattagccaggtgtggtggcgcatgcctgtaatcccagctactcgggaggctgaggcaggacaatcgcttgaacccaggaggcagaggttgtgatgaatcaagatcacaccattgcactccagcctgggcaacaagagtgagactccatcttaaaaaaaaaagttatagtggaaggaattttttctcatgtgtgttctgaaaatccacctcgtggttgaccatctgttagggccttgaattcacattggcacgtgagctaaagaggctggtggtataatggaaaataatcagctgggtgtggtggctcatgcctgtaatcccagcactttgggaggccgagatgggtggatcacgaggtcaggagatccagaccatcctgtctaacacggtgaaaccccgtctctactaaaaatacaaaaaaattagccaggcatggtggtgggcgcttgtagttccagctactcgggaggctgaggcaggagaatggtgtgaacccaggaggcggagcttgcagagagtcgagatcgtgccactgcactccagcctgggcaagaaggcgagactccgtctcaaaaaaaaaaaaaaaagaaaagaatcacacagggaattgcaacttgaattctggtcctaactagtgagtcaagtcatttaactacattattgtctattgcttaatcagcttcatggattgttgaaccagatggccgtgttttatatatagccctgcaacttactataatagctgtataaccttgggcttaatccctctttgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgaaagtattcagatatttacagttcaggtttcaattatataactaatatttttctttattgttaaatgtaactaactctaaagctcttatgtattttaagacagtacttaaagttgaacattcatgtattaaaacttttatgagaattattaatatttattaactcatgattaatgtttgctttaagttggaaataaaaaaaacaaaacccgaaataacctgctttgaagttagttcatttttatatttgttatgggtatgtgttatggatcttcctccataaaatttcttttcactcgtctgttattgtcttttccagcatggcagcaatttgataggtatgtctgatctcaatgtgcctgagcagctctatcagtacatggttggaggacataggcgctttcaaacaggaatgcatagggagaaacataaatcaccaagttatcaaatcaaagtaagtacacagcaaagtaatagatcaaaagtctggaagctgggaagttaattggaaaatactagtgttcatcctgacattggtaaatatgttaattttaagcatacttatcagaggaattttataaaaatttagaactcttttacatgcataaactcttctttcaataggaaggagataccataaatgtggatgtgacttgtccaggtgctactctagctttggctatgatctacttaaaaaccaataacaggtatttctacccactcacccttcctcccacggtgatagtgtgatatcctctctgaccttggttgtaaaattcagttatctcatgtgtttctttcccctgtgctggattaagctgattttcgttctttcaagtactgtaagtttttgaaagaaaactggcagtatttgaagttataaagattttacctagaaataatgtatttggctattttaattgtatttgacaatatagttttcaatttctgttcatttctgttttgtagttgatgtcagtaacacccaaacaatgcccatgtttgttttcattaatttagcatattgctgtgaggactggttaagccagaaatacttatcattagtgtgatcttggctaccatgtaaaacaatggtttttgcctacttcaagagcttttgtaattaccaaaccgtctaccttcctaacttgctatattaatgctgatgcttgaaagtaagatctttggcatttatgcttacacgttgcatgaagagtaagttgagtacaacatgttatgccatgtattaagtctattaattaaaaacaaattctaagattcaaggagcttttcagtgttccacatttctccctttagaaaaagtaaatgtgtgcagaattaacaaagtgtttaaaaatagatatttattattttactatttggatgaatgtgtagggcagtgcttccttggcactggggatatttcattgagcaaaactaaaaatatcttccctcatggagtttatgttatagtaagacatacgtgtacctctataataactattacgttagaaggtataaagtattgtgaaaaatatatagagcagtagtggagtgggaagaaatgttttgaaatagagcttgagattcttgattgtcttgccctctacttgaacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaagccactgtgttttggtttgattcatcccatagcaaaaggcaacttcagcaggccctttctgaggctctggaggggccctggcaatgtatccatttggtcatttgcttttgacaaaagcagacattttagctgtaattggctaaaattctgatctctttctgccctcatgttgggtggtggtggagtggatgtgggcattttgaggatccagcaaaagaagaattgagttgagtcattgagtttgggttccatgggatttatttatgtggtatggagtcatttctgtgtattttattgctagctgtccctgtgtaaaacagattcagaatagtcttcacctccctcgtgctgatttacctggtggtgtaatgtaaatatgcaagaccatagattacatcacgattgtgtcacatgacatgtgcatttgcaggaacatggatggagctggaggccattattctcagcaaactaacacaagaacagaaaaccaaatatcgcatgttctcacttataagtgggagctaaatgatgagaacacatggacacatcgaggggaacaacacacactggggcccatcagggttggaggatgggaagagagacagcatcaggaaaaataactaatgagtactaggcttaatacctgggtgatgaaataatctgcacaacaaacccccatgacacatgtttacctatgtaacaaccctgcacttttatccctgaacttaaaataaaagttgaataagaaaaatagaaatgtacaaagctagaaaagagtgtagctcatcccatctgggaattattccaaatcttacagttcatacataaaaatagtttgataaagattttcctaagtgtgccaagaatcctgaaaacttatcttccattatcgatcctgagctatgaagccagaagaaaaatttaaatctatcaataataaaatactagagccaaaatagtttattattctcttctctcatagactatgatattacaacattattgaagaggcaatcaaagaatatgcaggcaaaaatgttgggaaaggagtattacagagataggtcaggaatttgtttaattaaaattgctattttactgagttttacatatgtttagtggtagcggtagctagagtagactttgctggagtctgggccattgagattggtattattaaggttatgttggcctcatttgctcttaccttctggcatacacaggatacatctcacttgatttctcacaagtctttggtacccatgaccactcccacctttttacaattttcacttttgctggcttctctggactcacactgtcaattttcccctctggctaactgttctcagtcatctctacagaattctcttcttctgggtccttgtgttgttgagggctttatcctagggcttatttttttctctctgagcaagcttgtccacccccattgcttcagtcccacctatctgctgacaactgctgattccacatctccagctcagacctctttcctaggctctacaccaggaattggcaaactttttctgtaaagcgatgataacaaatattttatcggcttgctggtcattgtactgtctctgtcacatctgctcaactctgctaaggtggtgcaaatatagccacagaaaatagtaaaagaatgggtgtggccatgttccaataaaacttgatttataaaaataagcctgcttcatgggctatagtttgccaactcctgttctaaaccagaatattcaactcccttctggaaatttccacttgggttttctcaagttcctaaacataacattgtccccagccaatttcatcttattccctcctatgcattccttcttaatgaatgatccactgtccaccagatgtccaagccagaaattcaggcagcatacttgatttcattccccacattcaatgagtcacaaaatcatgtcaattctactttctcaacatccccctaatccattcttttttctctttctccactgccttctttcaccccctctcatctctcacctcctatgacctcctcactgtgctgcaatcagagggatcaagccacccttggattttaaaagccttcagtaacagtagtccctgcctttctttggctgaagtctaaacttcttgaaacagagtgagaagcctgcgcaattggaccatttccccatgttagccaaattcctctcatctgtctgctcctcctgcctctgggaccctgcacatatatttcttctgcttaaagaatgtgtagcaggtgaagcaactatctgaggccagtataccatgggcagtaagaagaatttaccaagacagttgtagataaaggcagatttattgaagaaagtatgaaaatatgttgcaaggcagcaacaggcaggccagcaagagaggaactgaatgccaagagacaaaggcttgctgggggttttataggatgttgcttttgctgcgtgctgaagagagctttgtgcagtactgataacaccaaggttgcagtgggataacctgcatttttccatcagctgagggcctgatggtagctgggcacaggaagattgtgagctatttgtgcaggagggctatggtcctggaccatgaagaaaggcaaacttacagcttatctgctttctctttcttttttcctcagtgtcaccagcctgattccttttgcctaattaggactccacagaattattctcctttctcatccttccagctgtcttctaagtctcaacttggatgttacttcctctgggaaatgtctcctcacctctcaagactgtctctctgtgcaccactacaacaaatgggacctgggccacttcacttttacaattccagtttacagacctgcattgccccaaacccatgagaccaaaaactccctgagggcaaagatggcctcttatttactcttgattccccagcacctagcacagcactaaacactgtacccactgaaagaacatctgaaggatgagagtttatagcaaaagtggtttccactgacattcccttctctcttccccaactttggattgaggagcccaggagctggtcaggtggcaagataagatgagaaaggagaagtcattacttggggcctctgttttgctggtgttttgctggtgtgtggagatggtgggtttcccttgaatacctgggaggcaggagcaggcatgaactactccagcctctgggttctggacccacatggagggctgctgctctctggcacccatcagtccttaaccatctggtctccagccagggaaggagtgtggtggtggagaagcctctctgtcccacccactcatcccaggagctcacgagaatcagccaaagtccgagttctgcaccctgagttaggaactctataactttagactttccctgaaatttgggaattctcttaactagtatgaaagcagttacatcatcctaggtcctcctaaaatagacacatgtatccaaatataggcacatgtgttgcaaacataacatgtatacatatataaatatatacatataatttttgttttgaaataagtataaacacaacaagttacaaatatagtactgagagatccttgtgcctatggccccgcctccctcaggcagtatcttacataactatagttcatgattacaactggaaagttgccattggcacaatatcagaaactagtctgcagaccttgctcagatttcaccaggttttttgtgcactcatttgctttcctgaaaatattttaaggtttttctacatgacttatctccctgacatactgtgagataagattttttttttctctgaatgagcttagagaacaatcaatgtgagagatgggaaggatgatttggtgcaactctgttttatccatggtgagtctggacctcagagcagaaggaccctcgtctctcctctggggagtcctggtgccacctcagtgcaggctgctaagttatccgggtctgactttcttcttctctgctaatatttgtcttaagcatgtaacacagccatgcttattaatgatgaggagacagccaatgaaaattaattttttcaaagatgaatagatatctagattttttcaagcacaactcaattaagaaaatatcacctcactgagccccaaatgagttaggtctcactgagaaagtgtctcctagtgccaggcaaagtgcctcatatttgtaatcccagcacttctggagactgagataggaggatctcatgagcccaggagttcaagaccagcctgggtaacatggcaaaaccctgtccctacagaaaatacaaaaaaaaaaaaaaaaaaaatagctgtgcatggtggcgtgcacctgtggtcccagctactctggagtctgaggtgggagaatcgcttgaatccaggaggttaaggctacagtgagctgtgtttgtaccaccgcactccagcctgggtgacagagccagcctctgtttccaaaaaaaaaaaaaaaaagaaagaaagaaagaaaggaaaggaaaatgccccctagtggattacgttttaaccactgtgctaacttgagagatagcctgctatctctttacgggacatgagggctgataagcacctcattgcatggtcctggggactgatgaacaaaggctaacatgtggaaaagagcaactaaagaaagaagagccacctccaggttaattagtagaagtctcctcgctgatatgctctcatacactaaaacagcagtaaaaacaacctgcacattggcatcgagggcacagataaacttgccgaggacccttaccacgacagagggatgctttatatgaatccttagtagattaattaagttcttgctatttccagttggaaatgatactgtcctcttagggctattcagagaagttcatcttgatgaagtgagctgtcctagaatggcagttcccgggcagcagagcctgggctcaaggaaggtggaaagagggggtggcgaggagctgccaggtgcaaatgtcaggccagcaatgcagtccagcttgcatggacgtgcatcacctaggaagttgtgacttggctgcattttccacttcaggtgagatggaagggtgaactctacctcacctcctggtgaggttgatgtttcctggtgtttataactttctttgtaaatacttgcaaggaatttaccattttaatgctggaagagacgtctattccttcataagaggacctgagtggatcttgattgcaggccttatgctgggcagagctaaggaaattcaatttgtctccaatcttatttgaatgttctttttttttttttttttttttttgagacagagtcttgctctctcacccaggctggagtgcaatggcacgatctcggctcactgcaacctctgcctgctgggttcaagcaattctcctgcctcagcctccccagtatctgggactacaggagcatgccaccatgcccggctaattttttgtatttttagtagagatggggtttcaccatgctggccaggctggtctcgaactcctgacctcgtgatccacccgtcttggcctcccaaaatgctgggattacgggcattagccaccgcgcccggcctatttgaacgttcttatgcctgctacaagtgcagcagcagaatctccacacatcttgagtgcgaaagtttcctgtagttcctttagcatggagaggctggggaaggttacagactgatttgtactctttagacatatagttgatcattgaacaacacacgtctgaactgttacacacagatttttttcaataaatgtgttagaaaatgttttggagttttgcaacaatttgaaaaaactcaaagacaaaccatgcagctagaaatatcaacaaaaatagaaaaagttaagtatgtcatgaatgcataaaatgtatgtagatacctagtctattttattatttactaccataaaatataacaaaactattgcaaaagttaaaatttagtaaaacttatgtacacactcacagatcgtatatggtgctattctcagttgagagaagtgtatacaaacatcaagatgcagtattaaattgtaactgcataaatttaaccgtagtgcataccacagtacggtaataagttcatagcctcctcctgttgctgttgcaatgagctcaggtgttgcaagtatccacttaaaacgttctgtgatactcaacattccatcatgagcaggtcatccccagtgaattgcgcatcccagtaaaaagtgccctctccctgttcacgtgtatttttcatcctgtttcgcgctgtactgtaaaccttgaataacaccatgggatccacatgaagtggcactagtgatgctggaagtgctcccaacaagcagagaaaagtcatgacatttgacattacaagaaaaacttgatttgcttgatatgtaacagagactgaggtctgtagctggggttgcttccatttcagacagatgattcatcttgtaaacaggcggtgtaaacttactgtatggataaatacataacagtaccatagatgtattttctccttagaaacgtttccttttctctagcttactttattgtaagaatacagtatataatacatataacatacaaaatacatgttattaactgttgctggtcaacagcaggctatcagtagttaagtttgggggaatcagaattatacctggattttctactgtgtacggtcagtgtgccaagcccccaagttgttcaagggtcaactgtaatcctaaaagaatctaatacaatattgtacacagtaagtggtcagtaaataaggaattgaactaaataagaatacataaatctcagaatatgtgcaacctgatcgtagtacacagagatctctctatatctcttttctcagttcatgccattatttcaggtagaaagcaccttattttgaattagttgtctttagagcaaaaatccgtctaagagtgcagtgtggtttcctatgcacaatctggaatagtccattgcttcatgcctaccctggacatgaagggccgtgccacagtggaagtctctatgcatccacccctgtctatacctgagcaactcattcctctttgctgctctcttacaggctacagagtgcggtggcgccagcacagaactctgctcaatgtccctctgtgctttcacgatgctgatggattatgaaggtagggaagaatgtacagccaggaggccattaggagggcaactaatttataaaatcgcatttgtagaatttaatgcatccaacacctaccaggggaaaggtgggcaaaagctataccaacaccacccaagtcaaaaccaaaacaacaggaaaagaaaattatgtggatgtagaatttctgataacatcattcccaagatgccttatccaagaggaactgctacaataatattttaagtggaaataaatacatgctggaagcattatatattagtagactttgtttttttttttccccaaagtactttctcaagcacatcaacataagccccctaagagacatttcacattaaaaataaaacgtctgcccactgctggtttctcaatttgcctccaccttctgtcccctttaatgaactgggccacgaggtgagtcagagaggataaagggagtggtaagaatttgaggagagaagagagtgaggctagaataggaaatcaggaaatgcgattcggtccccctgttcctcacatggggccaccctcttgttgcccagtgtggtttcttcttgagggttctgcatgattcctcaatcccagggaattccacaggatgttccacccaagaccattgggctcccacctctactcttttgccagttaatgaataggcaggaatttcactgcctggaaagaggaacaatgctttctggtccttatttcacatctaaaatagagaggtcaattgatttattgctaaatatctttgaacactaaaatagaagttttacaacatatatactacctggttgctctagacttaagccagggaaaagtacagattcaacatttaaaattgagatagacgctttccacttagtgctaccagtcttgctttatttcatgagaatgagaatataataatatgccatacgttcatttgggggaaagattgatgtcttataatttataattacagaaaacatgtgagttcactgggaataaagaaattttgaagataataagatactttcacttatgtcgtaatttctatgtcatttggtgtaggatgtggagatattaacatttacacctaacttaagtttgtcatccaggacctgaaagggttttgtctatcagctgcacccctgggtagcgacacaaccttggggaaggcctcagccccatccctcgtacagcaggaatgagaacagcactgcctgttgggaagcttgagggaggctatggacgtgcagcgcttggcagagggtctcgtcatggaaggttccagcaaatgtgagatacttttctgatttcattttctccaaaagaaagggaataaaagaagaggggaggaaataagactaattgtgagagataaagtacaaaggtgagggaaggagtaaggagacatgaaggcagcgtggagcagctgaggggggagattgctttcaccacttcccagcatctattgcagattccaccctcaatcattttgtaaggaccctttattcaaggtcatgtttgaaccctgctgagccagtggcgtgggtgtctgagagaatcattaacttaatttgactatctggtctgtggatgcgtttactctcatgtaagtcaacaacatcctgggattgggacacactttctgggcactgctggccagtcccaaaatggaacataaggaagtggttcttctacttcttttatttctgaaatcaggtaagacatagtttttttaaattataataattattttttctcccacaatgcagtacaaatacatatgccatggctttatgtgcaattcatttaatttttgattcatgaaactcccagttgaaaatcttgtataagattgaggaattcttcaagaaataagtttagttttcctgtgaagattgtcagcgtgctggaatgaatgcgcagagaaaataatgggtggtttttcaaatctaaatgagtgcacccacataatggccagtctaattgaaaaagagccaatgtagctaactatgcaaaggacggctaagctcttcgcctggttctcagtttgactaatttatataatctctcttacggtgtcatgctcccctcacttgcaagttaaaacaatgaaatttctctttgaatatattctgttctctcaccagttcatggtggtggcagcgtcagggattcagcatttctccctttgttatggcctgaggaaggctttccatcagtatacgtttgcctctaatccccggaaaaatcacacgcatccatttgccagatgctgtgtgcagacagtgattcaacaaatactcacttagtgcttgggttaggtcgctacatttttacacatacatacatacctgtgtgtgaatgtgagtgtgagtgtgtgtcctttacaaatactagcttatttagctcgcggtataggtagggtagcatattcaccctcattttataaacaaagaaatctagacaggaaaatcatgttatttgctcagtgaccaaattctcaaatctgggaaataaagaaaactggatttaagccaggtttcccagaaggaatctagggctcttctcacttttcagctttgtttaagcctttgaaataatattctaaacatgtcctagtagttctttttctttttctttttttaaaaaaaagctttatggagatataattaatgtatagaattcacccatttaggcatacaatccaatggatttcaatatattgagagttgtgcagccaccatcagaataaattttaaaactattcatacccccaaaaacgcactccactctccttagctgttacccccgatctgcagcttctggcaaccactaatctactttctgtatttatatctttgccattttgaacatttcatacgaacggaatcatacgatttgctagtagttcttcctgtaaataatgtatacttgaaattcaatctataaattaccagataaaattttacaagttgcactttagagtcaaatacatttgaatttagtggaagccattcaaggagctatcaaacaaaatacagagcaggagaaaattaaagaaatttttgtaagaaattggtgtatgttgggggtgtgaatattatatttcaatgcatggaaactatgacatagatcactgtgaacttattcagtgggctacacccaaaggctagaacaaacttctccgccacaggattaccaatgttttaaccaacctggggggaacattctctcataagctcttttggaaagccaggctttctgtggatgtatcatctttccagtgtgctgcaatgcccggggagaggaaaaagtttcttttacagccatgcttagtgggaagtggagaaacatcttccatttcacaaattaagtcttttacacatgcaaatatgcatacacattcacacaccacagtgaggaagaaattctcacaccattaataaaatacatttgcatcagtagcaatatacatctgcattttgcctataatataaatgtatttttccactaaaagatttgatgtttccttgccagcaaataagccctatcaaatcctattgccatatgagtcctagaggtgaataagagaaaaaaaaaatgggggaaaattatttcaaattaaaaagaaaaaagtttgattctgttttgggatatttcctagggacaggagctggggaggggatctcagcagcgatgcgctatgaagtataataacatgacacagagaacttaattgaagggggaaataaatggaagttttctttttttgaatatcaattgtagcctgctctgctatacttcaaaaaaactcttcagaaagtttaactgaactcaccgtaggacacactttgtggatttattgtgtgttttgaagtcacactgcgagctatagaattaaccaaaacacaactcttcttggaaatgagagttcaagttggcagaaagtgcggggtaaagacatggatatgggcctaaagcatctatttctttgtgatcttttgatacatctctcaagtgcttttcagtggattaggtttagaatgcatcagccaactcctgctcaataatccatttttccagcccggaatgtcttaaattgaggaaggacgaagtcccagaggtggggagcagggggactttggccgaggactttgcatgaattgatgagcgtgcatcctcctccctgtgctctgtgtaccctcaggaggtcaggacgggcctttctgagaatgagaatctgttcatttgccttcctactggatatttgtcatcagcatacaaaccagtgcgctctgcagtgtgtcatctttcagaacctcccctgacctcatcttccctggagggctcgctgtcttcagagccaggcttgtctcccgctgccgcctccactgctctcctcgtcactctataacccactccctctgcctgcagcccccaccacgcccctcaaagtggtcaaggttgtcctgttgtctaattccatggagcttggctatcttcattttattagcctcttttggcctcttacccctgtgaaaatcactagcattctgtgcgaaggatggagctggcatctccaggcttggaatagacctaccaaagctcagccagatgtccggaagagcctcaggacaagggaacaccctgtagccttgtggtgggagcacagctgaggcccccttggccaccctctgccacgaccaggcagaaagcagctttcggacagattcgttgtctcagatttgatctcaaagaaaaaccaagaccagtatttgtcccaggttctgcttttttacaatttcctccgaaatccagatacctgtcaacaccttggaaaaactgatttctccccagttagtagtgttgtgtgactgtcatcagcccagtacaaaaatggccttctttgttggggagcttcttaccctccagtgttttgcccaatttttgtccaagttggcaacataatttagttcagttcttgtttatttccaccatcatctatgcaccaaaatttatgtgtctcaaggagggaccattcagaggatgcttcccaccagttcaagtgacagtgtcagaaccaaagcgcatattgtaggaaatcaaacaatggcctccaagttccatttctacccagggatgaacaaatcaacatcaatcttggtaacacaactgccactgatggtgccttactcttctctcatgacatggcacaattgatagcaaacataaaatttgttcttgtttaaggatttatatccactaatatggtaacatagtagtggttccatagttctaacctgtttatcaatccagttaatcttttactatcttgcaatctgttaatgaaactgtttttctttgttttataatttcaacttttagagtcaggggtacatgtgcaggtttgttacatcactaaattgcgtgacactgagctttggggtacaaatgattcccatcacccaggtagtgagctaaatacctactaaataggtagtttttcagcccttgcctcgctccctctctcccttctctggtagtccccagtgtctttagttgccatctttatttatgtccacatgcccaactgtgtgttcttaactaaacattttgattcatagctacccattctacttccagtaaacagcaagttttatttggttaatgctaaccaaatagattaaaaggaagtcatgacaattagacattggcattgatttactgaccatttattccacttggatctcccacctctaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcaggtattttcatcgtcgttgcacctacccagaaatctgtaattcagatggcaagtaatttactcacaaatttattaacgatttaagaggaaagagaaatttatggagccagagtttggaactatatttgctcatagcatgtgaagccatactaacagcttcttgttaaggtttactggagtcttcattagaaaaataccctaaaaggaagttatttgtttttacaccggacataaacattagcagttattgttctgagctccagtttttaacatcatcatcagtaaatgtttgttgaggatcatatgaatgaaagtgtcctagatagatctgagcaatgacttatagctacaagatccagtgcctgcccttcagtatttaaggtgactggatataatgttaaaaaaaaaaaaagacagcctaagtgagctacaggcataatcaatgcatgttctacccagatccagaagaaagaacagtgcctaaggttgaggcagctagagaaggctcagggaggaggtgggaaccgagctgggtttggagttgagagagctcttgaaaagcaccaggaaggcaggggaagatgcggccctgcactttctgagggggaccattaagagatcaagttgactaaagcagagactttgtgtaggtgatgagcctgggaaagtagctatggatgccagactgagcacccatagcaggaccacgggatggagatgggaggggtcaggggccagggtggggtggaatgtggggcagaggttcaggggaactgatcagagttgggaggtcatggagatggactatcttggggaatgggttcaaagcaaccagagttgcttctttctgacccaaaaacaaaaattaagaagatgagtgaagaagaagtaaaacagttgaaacagaaagaaagagaaaattatgagggagggaaggtaagggcagataagatttactgccacgttggtgtattttgttcagtacttcatcaatgccatgcccaaataactgaaagaggcagcaattctgagctctctggtccctcaagatagtcaatgatctttagcatttctcatttattaataaacatttgttttctttaaataaagaaaaatacttattggatttcctgcttcgttctgcagggcattccaatatcacagtaaagagcaacaatgtgtgataatggctgaaaacaggaagtcctccataatcattaggatgagagatgcagttttatttgaaaagtaaagtgagtacattttcttcctcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggacgaagccttgtaaaacagaaatactgaggtgttttaatcctcagaaacatttagattgggacacaaatcttattttttactcttaaatttttcacattttgggggacatggtctatatttttctcagatttctgatatgttgtcttttaaaaatgtgtaaaagttacagttccttttctatagtttattttaaaatgtgggtcaatagtcccactgcttagaataagaggcacacaggatttcaatagaaattgcatgcctttttagatgtgcgaatgtttcattaagcgtatgaatatttgaagagatgtatgacactttaaaaactgtttcctctactgtgttggtggccaggtattaagactgttaataataacaatttagctctccaaatatcctgcatcacaggtgttaaagaggactggaaacaccttagttcttgtattcttgaggatgatttgccatattgtgtctagtatcacggcaaaactccaagtagcattttaaatagtatttatttgggttggaattatttctatgcattgactcatcttcctgggtttcattagctgtacgcattgtactttcttccttaccactatttatctcgaattcttgagattaaagtacagatgaaatctaaactttatctggtaaagttattagttcttacaagtagcaagcaaacggtaaactaaataggatgacctaattgtaccagatttaaaaaaaaaaacaaaaaaccctgattctcctgattctctctacaaaatgctaacatttaaatatgtcatttgtaaattgttaaccagaaggaacatgggaatgactgtaggttgagtttgaagtgtgaagtttgaaggcttagtttgcttgttttcaaagtgacagaagggagcaaaaggttatataaactccggtgggtacatacagttgctgtgggatattgacctgctgctaacttacctgccagggtttttccaggaacagtcagtgttagatcacgtttacttctgccacttgccaccagccacactgccttcaccgagtccaagaccctatcaccactggttggggctacttgtagctgtacacctgatctcgaagaaatataacttccctgtttaaagcccttcctagtgcccttaaaataagacccaaagacttcccaaatgtgccagggcccggcattatttacgtaacccccggctgctgtttgcttggcttgctaaacttttctacaaagtttctggccttacttctgttccttcaccaccccaagcacacgccctcctgcctgggaccctcttcacctttgtcctgctgtgccagctccttcttatcgcctaggtgtcagctcaatcatcacctcctttgcaaatcttccttgacccctagacctccctttcacaaagtaccttgagtttacactttgatgagtgtcttatgtctactgtaatactatgtcccaatgaagatgtactggcaatcataataggtagtattgggttaaaagcattagtttgctgtaggtacgttaggagtactccccatgtgattgatcagtgaatttaaaaatggctaaagtgggtaaccttaaatgatggtgcaaatataccttaaacattttatattttcattgaaaacacaagtgtacttgacacctcttgatgtagagcagaggctttttttcttcgaatatggggtcaccagtagaaggtctctggtgcatttcctgcataaactatgctctagtgcaacatctacaataattactttccttatttttgaagtggaccatatctcgacatttattaatcaatctgcatgtgtaaaacctttagatttttatgaattcctcctcaagctttatagtcaactatatgagtggattgccctctgtggatctgatagcaattttttaaatgattcacgtttcaacttgttaaaaacatttaatttagttaaaaaccaaacaaaaaagagctttgtttcttttcacattcatttctcagtttagatcatctttaattaaatataaatgtaagaaagttggaaaatgcaaagaaacgactcgttgtaagcacataactcacgtggggggaacagacatgggtgggcacactagcaaacacctgccagctgcatgtggacccaggtgggcaccggactgttttaaacacaggagagggcccattgtctaactggtgagttggttgagtggaagctggttgagaacttttactgcaaaccatttacagtagaccacaattttatagtcctgtttggcactttttcatatcactgggagcctgaagaaatagaagtgggttggatctctttcagcctcggaaaagcctgccattcccccatctaaaaaccctttccccattctcttactctgtctcatcatgtatgtaacatgtatccatgtatcatcattaagtgatctcattttatattgtttacttgaatatttcctgtaacccccctgtctgattccactagaatgtgagctctatgatggccaagcctctggctgcactgtgccccgtgtgtccccagcatcctggtggggctcaatacacagagagctcataagtagcatttgaatacatgaatcaaagtatggaatggcccagtttactgcagcctttttgcaggtgcaaaagatgatcttttagaaagcagaaacagggggtctggtgcatgagatctttttctcaatgtgactgtgctgtgcagaccttcacgtggtgtcttgtgaaagactttgaccactgtgtggactttccttcagtgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctccgggttcaagcgattctcctacctcagcctcccaagtagctggaattacatgcatgtgccaccatgcctggctaattttacatttttagtagagacagggtttctccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaactaaaaaaaaaaaatacctactgaaaaaactgtcatcgtttcacatttctggctacgttagtgcaaaagggaataaataaaggtgagatttgtgtgacagtgtggatatggtactgtgtgacaactcagttctcccatcacttccacctgtttgaatcatcgggatcctttatttgtacaccatgttatcggtatttgcccttaagcaccaccaatgcaccacttttatattaagtctgcccgttttccttagtactccataaaatttaagtcacatattactctgcctcaccatgttacttcaataattctgaatcaaagtttaagtttgtgaataattttgcaaaaaaagagccaatcatgcttctcaacaacataaaaagagaagcgccgtcacttcaggtgaatattgttctccgtgaggccatgagcataaacaaaaactccagactaaaaccctgagacggtgccaggtcattcagcagtcagcggaatgatcagtataatttcaaacaaagttttaaagatcattattgaaatgatgtattttgagcttcctggatctgttcctttatgtctaccttagttcatttgggctgctgtgacaaaaatatcataaactggagagtttataaacaacagaaatttatttctcaccgttctaggggctgtgatgtccaagaccaaggcactagcagtgtctggtgaggccctgcttcctcatagatgacacattctggctttgtcctcacatggtgtcaggggctagctaattccctggggcttctttcataagtgcactaatctctgtcctgagggtagagccctcgtaacctgattgactcccaaaagccccacctcagtactatcacattgaggattaagtttcaatataacttttgaggagacacaaacattcagaccatagctttatctatcatgaatttgggggaattttcagtcactgttgcttcaaatgtttcttctgtttctttctcttttttttttttttttttgagacagagtcttgctctgttgcccaggctggagtgcagtggcacgatctcagctcactgcaagctcctcctcccaggttcatgccattctcctgcctcagtctcccgagtagctgggactacaggcgcctgccaccacgccccgctaattttttgtatttttagtagagacagggtttcaccgtgttagccaggatggtctcgatctcctgaccttgcgatctgcccgcctcggcctcccaaattgctggcattataggcgtaagccaccatgcctggctttctctttttcttctctttctggtatttccaaaaagtctccatgttccaccttttgtaattgtctcacagttcttgactcttgttctgttttttctttttcattcttttctctcattgtgtgtcagcttttgaagtatctattgacatctctttgagctcactgattctttcattggccatatccattcttttgatgaacccatcaaaggcattcttcatttctgttatggtgttttttatttctagtatttcatctttatttcttcttagtgtttttatctctttgcttacattacccatctgttcttgcatgttatgccatttttacattagagcccctagcatgttaatcttagttattttaaattcctggttggatacttccgatatttctttcatatctgagtctggttctgatgcttgctctgtctcttcaaactgtggggtttcttgtcttttagtatgctttgtaattttttgtttgaggctgtatatgatgtactgggtgaaacgaactgagttaaataaggctttagtatgagattttgtgtttctctggctaggagttaggctttgtttactctttgctatatagtcatggatgtcagaggctaaaatttcctctagtgtccttgtgttgtctcccctgtcttctctggggagctccctagaggcttctttgtaaagtagctctgagtcttgcagtgtctatccctaatcatgggaaaacatcaaacaaacccatacagcgggacatctgacaaagtaccaagtgtcaaggatcatggattgaatcctgaaacagaggaaggacactgaaggaaagactgggaaaacctgactgaggtctggagtttagttagtgatactataccaagacgaatttcttagttttgataatttgttaacagttatgttaacattgggggtagctatgcaaggggtgtgagaatgctgttatatctttaaccttggcccatggttaaggtgtttccagtgtaaggtcactgttattccttgtagttaacatatatttggcaccacaggattcattctggaattctccttggcttatttataactttttttctagtagtgagaaacctggctttcatgcagagtttacaaacgccaatttaaacttttgttttgtcatacgcaatgattttattacctgtctttatttcagagcttatgaatttttaattattctaagggctaacatagaacttttccatgttttctactcttcaagagtaggtaagactttagtttgtaatacattacaaaaggaatcctgtggttctctaagagctaatttgtcttggcaaaaggccttagcaagctgtgagtggtggctcatgcctgtaatcccagcactttgatctgagacggctggatcacctgaggccagaagtttgagaccagttttgccaacatggcgaaaccccatctctgctaaaaatacaaaaaattagccaggcataatgccatgcacctgtagtcccagctacttgggaggctgaggcaggagaatcgcttgaacctcggaagtggaggttgcagtgagccgagattgtgccactgcactccagcctgggaaacagcgagactgtctcaaaacaaacaaaaaaaccaaaaaacaaaaaaattagacgggcgtggtggcatgcacctacagtcccagctactcaggaggctgaggcaggagaatcgcttgaacccaggagttggaggttgcactgagcagagatcatgccgctgcactctagcctgggtgacacagtgagtatccatctcaaaacaacaacaacaacaacaacaacaaaaacaaattaaaaaacccaacaacaacaaaaccagcaaacaaaaaaactaaacaggctttagggaaagagcaatctaattatctgattatatgattggcactaagatgggaatgactctggcctgatttcttcagtttacattttaaaataggagcttagttagcccccaaataatatgtaattgatgtattagcgttggggagtgaatatttttcaaagcagaagatatttctcaattcttgcttacttttagaggttgaagttcaaggaagccccttccttggcactgtatcccagggaggtatttggagttaatttcagggcttagcagtgactctttagaaaagcagtatacgattgaaatgtaatgtgttacaaatgagatcactacaagtaatttaaaaatgtgctagtagtgtttttttttctgagacggagtctcgctctgaagcccaggctggagtgcagtggcacgatctcagctcactgcaagctccgcctcccgggttcgcgccattctcctgcctcagcctccctagtagctgggactacaggcgcctgccaacacgtctggctaattttttgtatttttagtagagacggggtttcaccgtgttagccaggatggtctcggtctcctgacctcgtgatcctcccacctcagcctcccaaagtgctgggattacaggagtgagccaccacacccagcctctagtagtacttttatcaaaagtaaatagaaacatgaaattaattttcacaatacattttatttaaactaatatgttcacaatgttaaaatttcaacatgtaatcactataaaaactactagtgagatatttcacattacttttttcatgtaagcctttgaaatctggtgtgtattttatatttactgtacatcctgatttggaataaccacatttcaatctttcaatagccacatgtggctagtggctactgtgttagagcagttctagaacaaaggagtccctttaaaactattttgaagtcatcgtctataaggcaatatgaaagctgatctgaatgatttctccttttccaggaaaggaaacaaaaatgaaatcatgttagggctgcatattttatggatcccaggagaaatacacagtctgaaagaatgatctcagtcagaaactcagaatgaatcatatgaattaaacattggacaatgtccaatgctcagcatgtgtttttggtttatactaagagcatattatgccaccaaatacagatatttactattatacttcgtgtaggaggtatattgagacattgttctagactaccacagttccatattttgtgaaaagttatattgcactttttttttttttgagagtgtgcccaggctggagtgcaatggcatgatctcagctcactccagcctccacccccccaggttcaagggattctcctgcctcagcctccctagtagctgggattacaggtgggcaccaccacatctggctaattgttgtatttttagtagagatggggtttcgtcatgttggccaggctggtctcgaactcctgatctcaggtgatgcacctgcctcagcctcccaaagtgttaggattacaggcgtgatccaccatgcccagccttatatttcactctttgggaattgcatcttactgtaatcttaaactacactaaaataaataatgtaaaccttttgtcaaattgctcagagtaggtttctactttggttataaggaataaaattcatgcttttgtgtacacactagacatctaaagcaaccaaccatagttaacaagcagtgctcttaccaaaaggtaactctttctagaatctggcacaccatttaatatcagtatgagcatatggtgggtttaataattgttttccatgtttataagttttctttagttttataagcagttaaaatgaatccctttcactgaaatacaatctgtggtgggacttctagcttttctcgatcttacgctgctagatttatgtcactgccatagctatgcaatgggtgatatttacactatgctcaaacaaagcaaccagaaaaacacatcattgaataatacagatattctgaagtcaagcaagccaactttcattaacagatcaatttccttagaaaagttgatgaaactaaagactgaagttcaaagaaaaagccctctcaagggggtatgaatttctggtaacttatggggtaagaaaaagagcaagaaacttgaaagtagggaagagaaaaaagaaaaggagcaagagggaatagccagctctcaaaagagtctccaataggaaagcaaaatctgtatctagccagtaccaacatgtgaagaaagagtgagcatagcaaaattgagaaaggttgcttgaaaaccaaacaaaaaaccaaatacctgtaatcctagcactttgggagggtgaggtgggtggattgcctgcactcaggagttcaagaccagctgggcaacatggtgaaaccttgtctctactaaaatccaaaaaaaaaaaaaaaaattagccaggcatgggctgggctgggctgttttccaggctggtctcaaattcctgggcttaagtgatcctcccacttcagcctcacagtgttgggattacagtcacgagccactgtacccaaccatatgtcattctttagacacactgcttactaaatttctctttttaaaggatatactgaatttccggttgagccaacttaacagctaattttctattttagctttaaaacattgataagcaacatgaagcaatctagaacttaacctttaagtggctttattaaagcaatccagctatgaaaattatgcagaaatgattatctacaatcttaccagcacataagaaattcttcctctattctgaaataccatcttctcacaatatactttgatgttatgaatcaatgtctgttcttgaacattatttattgtctttctctattaaacaattccaaaataaaatttccagcacaactaaatattgttgatgataagaggatttttaaaaaagttcttttaaaacagaagcttatatacaacttagaatctaaaaccaatagatttatggtaaaccttaaaactgaaccaaaacaaacaaaaaccaaagttttaatcatttaaaaatcatgtttattgaggtacaacttatagtaaaacctgcccttttcagcgtatagcactgagtcttgacaaatgcacagttatgtaccaccaccgaccaaggcctggcacatttttacctcctcaaagttctccctggctgcttctcccactccttggcaaccactaacctgttttctgtccttatagtactgcttttttcagtgtcatataagtagaatcacactgtacatagtattttgagtctgacctctgtcaactggcataatgcatttgagaattatccatgttgctgtactggcagtgcattcttttttattgctgagcagtattcaattgcatggctgtaccagtttgtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattacccttccagacacctttctgtgttttcatacgtatatatgtatgacggtttgaccttaggcagagtagcattttcaaaattttacatggggaaactttctagatttaaagccattttatttttctgttctgtctggttttatctacgtgttatttacaatctgctgtgtaacaaattactacaaacttagtaccttaacacatatttatttcacagtttctgtgggtcaggagatcagaaatggttctatttcaaggtctctcacagggctgcaatcaagatgttggcatggctggggtctcatctgaaggctggactggagaagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcagatctggcaggctattgtgaggcaatgtgtcattttaccttataacgcagagttgtaacatgctactctgagcagctcatgacatctgcttgaaatttaagttgggcccctagtatgtgtttattataaagattttgatgctgcttttcagagttgggtaacctactttacccccttagctaatgtttcccaaatacacccaaacccacagaaaggaaaactattcctcattaactcacagccaacatcataaacattttatatctagagctgatgatacagtcaggtatttaccaacactcatgtatatatgtagagtttcaagaaataattgcttatccttactagattcaacatattctaatgtttcacatattatttttatttcttaattttttttttaaagatggggttttactctgttgcccaggctgaaatgcagtggcatgaccaggatttcgaccagaagtttgactgcagcctcaaactccttataacaaagaatcctgctgccttagcctcccgagtagctaggactatgggcacatgccaccagatctggtatattttaaaatttttgtagacatagggtctcgccatgttgcccacgctgattctgaactcctgttctcaagcaatcctcctgcctggtcttcccaaacttttgggcttacagctgtgagtcactgaccccagcttgtattcttttgattttaaaaaaatattctgaatgtgatccaccaaattaatttcaccatccactaataggtagcaacctgaatgaaaaatactgttataaactttacacaaaaccagagattataaacatttgcttccaaggagagaggtaaaaggtacttgtttgctctgatgggccctgtttccttcagtgccaggaagagtggctctcagacctttcttctggcatccctcatgtatgcagtgttggttattattttcaaggccttggtaaccaaatgcccctagtgtgaccagtcagactgacagtccatatctgtaatatggtggtaagtttcctttgcatgtctttctttctggcatcttagaacttttacctaggaaattttctttttgcttgaagtacatcattaagaattttcagtgaaggcagattcttaaagtttttgttttccagaagagatcttggaaaatataaaaggttggcagttatttcttttagtacatgagatagtattacaccaatgctgttgagaagtctattgtgaggcaatgtgtcttctttctctggctgcttttgagatttctctctgtcttttttaggggcagttttactcttatgtgactagaagtagatttcttcttttttttttaatattgcttgagattttattgggtttttgaatctgtggatagatatccttcaacagttctgaaagatttccagccattctcttcatatattatctgtgctgtattcttgtctctccttttagaacttcgattagtaaaaacatgtttgatgtcttttcccactcttgttttttgtttctcccatgctgaattctgtgtaatttcttttgaactatcttgtagtttacatttttttttttttttttttttttttgagataagagttttgctcttgttgctcgggctggagtgcaatggcaccatcttggctcactgcaacctctgcctcctgggttcaagcagttctcctacctcagcctcccaagtagctgggattacaggcatgcaccaccacgcccagctaatttttgtattctgagtagagacggggtttcaccatgttggccaggctggtctcgaactcctgacctcaggtgatctaccctcctcagcctcccaaagtgctggattacaggtgtgagccaccgtgccaggccttacattctctctcttaaagagaaaatgtaaggtatctaaatctgctgctaaaccatcattgtttttaattgtaataaggtctcttttatgtactcacattgataagagacaagtaggaaataatctttaaagggcaaactaatttaaatgtgttttcctgtctgtttacaggacttaccaaatgcacatcttagagttctgggtttctaatgtgtatctcctctatgaaattctttaaaaatatctgttcttggtatcccttaggttagtctcttttagaacttctaaatcaatggacccttaacttataggagccacctggacgttagcaacgtctacattaaacatgctgagcttttaaaagagacctgttagacatgctgagtattttgagataatatcattgttgtattgaaaactattgaaaactttaattttaaaatgcaaacattcttaaagtcctggttaattttataactataaaattagttataattttgagatttctgtcttgttttttataggggcagttttactcttaggtgactagaagtagatttcttcttttttataactataaaattaggtttacttttgttagaataaattaaagacagtgaacttgtaatttgaataactactaaaaatatacatgatgtattcttatttgggcccttgtgacaaaaatactattgtggctatagaaacctatcctatagtttgaagaactgagattactgtcagtattgagaacattcctccttcatcattagaaagattattaaaaaccagattcaaagaaactatcaatactacttatgaagtatgtctgtaaaaaaaattaagcctgaatcttatcaggcctctagaccagggattctcaaggtatgggccccagaccagaagtatcagcaacgaattgctaaaaatgcagaatcttgggtcagaaattggggaccagcaattggaattttagtaagtataccagatgattcagatgcctgctcaattttgaggatgactcttatcagtttagttattaggatttacaggggatggggaacatgttaaagagcaccaactagataaggtcaatcagtcaaaagtaagatgtctggacattctgggcctcctgatgtcttagaaagcacacaataccatctatggtgtatttttgtccaccatcccacccaattgcacctggatcttcctatttataggcaattagaacaagctcagtgttaccctgtaatgattaaaaaccaaatataggactgctatagcataaatgaccactttcttcaattaataagtggcacattaaaaatatatttatatatgtaattgttatagataaaaaaaacaaaatggccgggcgtggtggctcacacctgtaatcccagcactttgggaggccaaggcgggcagatgacaaggtcaggagattgagaccatcctggccaacatggtgaaacctcgtctctactaaaaatagaaaaattagctggcgtgcatctgtagtcccagctacttgggaggctgacgcaggagaatcgcttgaatccgggaggcggaggttgcagtgagccatgatcggaccactgcactccagccagggtgacagagcaacactacgtctcaaacaaacaaaaacacaacaacaaaataaagcttaaggaacatcaaccaaatgcaatatatgagccctatttaggatactataaaaagacattcacaataacacaggcaaaatgaacataaactaggtataggtgacagagaaatccaataaacattgaattattcactggggaaagaaatgatgtgtgggatttaagtctctaactctcccctatttacgccaaaagattgtccatgagttgaaaaccgttagagatgggtgacaactcaagagagattatagcgtcttccttgtgcttgtaaatgtcaaaaataaaagtaatttaaaactaaaacaaaaatgaaaccataattcttaagatgcagcttgaattcagttaactatagcagttgtatatgaagcatttcaaagaagttaatgacatcacagtattaaatccatctgacatggaaaccaactctaactacatcatagttttttttttttttttttttttttttttttttgagatgggagtctcgctctgccgtcaggctggagtacagtggcgtgacagatcactgcaacctccacctcgtgagttcaagcgactctcctgcctcagcctcctgagtagctgggactacaggcacatgccaccacgtccagctaatttttgtatttttagtagagacgagatttcaccatgttggccaggatagtctcagtatcttgatcttgtgatccgcctgcctcggcctcccaaagtggtgggattataggcatgaaccaccagtgcctggcctatggcacagttttaaaactgcatttgcctagaaagtggactgctgtatatagaccaagtgttgggctatatgactccattgtcttaggctatttggggttggaggaaggaagaggggtgaagtagaaaaggaacaagctaataaatgttttttaaaaagtagaatttaaaacaaaaccacgttcagctgaacaccagaactcaacaccaggataaaaatccaattttcaaagagctagaagatcaagctaagcacttattgtattttgctgaacgttaaaattatataaatgtactacagttgcctcaagatgttaaaaagtcagcttttcaaatctagtcacggcctactcatatgacagacccaatacaaatgagcaaaattgaaaagttacacatacagacaacttctcaaccaccaggctgtttagtttaagttagaagtcagaagttctgagactctccttttacccaccttgagcaaccgcagcaagttttcccttttcttcagggctgagctgcaacatcgtatttataacaggaagaaggctctctctctcactacctggcttcaagaaaatgaactgcagcaagacgttcttcaagtgttccacgttagctgcagactcctcttgattcctttccaatcttcttatttcacttttgagaagctggtgttagagaaatgagttaaaaatgggctttaggagcttctgattaaatatggcagactgaactcatgtatttttcttctcttccccccaaatttcccccttccctccatatggcaataaaggaaggaattcagttaactacagcagctgcatgtgaagcatttcaaaggagtttatgacatcaccgtataaaatccatttgacatgaaaaccggaactccaactatgagatagtttcaaagctgcatttgcctagaaagtggattgctgcatatgaaccaagtgttgggctatatgactccattgtcctaagctatttggggttggaaggaagaggggtgaagtagaaaagcaacaagctaatacaagaggagaaaaagtagatgagataacgtcaagacattctcacgagaaacagatgaagaggtggaaatgagtcagtccagcagcttaccaagtatcactgacaggagaggatgcatcctgtgtaaatactggagttcttgtctcagaagcacagggtatcatggaaatggagttgaaagctggggaactgatggaacgtctccatgaggagcaactaactggagccatgggttggtaccaagatgttccctctgccttctacttttgatagaaactaagccagtatggcatggggctctgaaaatgggctgaggggaacatcggtagcctccactaaccccctgcccctacgctgttcctgaagtcccaggcagttaagacgtccacagtgaacggcacttaaaaagttcagacacagtgaaaattcaggaatataagacaatgtaaaacactatcagagaaatgaggcaaagaacgatataaaaaaggtagtatcatgttcaagtctttgaggaagatttccaggttgaaaccaagccatagcttttagtatattttcattttaggttaggcaagaaagttagcgaactttgtcctcaaacctaggaccatttaaaaaagtgacaataaagaagacgaagaaatcatgaagagagtataaatttatgaaaatataacatttggccaggcgtggtggctcatgcctgtaatcccaacactttgggaggctgaggcaggcagatcatgaggtcaggagattcagaccgtcctggccaacatggtgaaaccgtgtctctagtaaaataaaaaaaattagccgggcatggtggtgcgtgcctgcagtcccagctactcgggaggctgaggcaggggaatcgcttgaacctgggaggcggagattgcagtgagctgagattgcaccactgcactccaaacctggtgacagagcaagactatctcaaaaaaaaaaaaaaaagaaaatataacatttaaataagtcatttaggtttactgggctagttagtgatttgttagctatgataatgtttttattagtgggaaaatgctattttatagagatgcatactgaagtatttaatggtggaatgtcatgatatatacaatttactgaaaataactgaattcggctttaaaataatctgacaaggatagctagtggccttgcacagtggcaggacagatctactaggaacagcaaagtacaggggaaaagcatgtacttttcagacagctatgagtttgaattttgttccaccatttaccagcttcaatttttctctcaaccagtgatgagattaaataatgtatgtagagcccagggcctgggtcataagaactcctcaataagcagtatgactatattctgaggggtgatttatcagtgagccagggtggaaatacctcatttgagtaatcctcaactgttctgcaacattcctagatgtttctggtgtctactttaaacaggaaaaacttcccatgccactttgccatctccacctgaaaactgtttagtagttcagtactataaatatcagttgaataatttaaattcactggttatctttagaattcaaagactcacacccattttttatttaagcatatgtgaacaatgatttgtgaacatctctctagtttctaaatctattacggtttcttaggaaaagtaggaattaagaaataatctttatgtaataggtgtaaaagaagtattttggctggatgcggtggctcttgcctgtaatacccacactttgggaggccaaggcaggtggatcacgaggtcaggagatcgagaccatcctggctaacatggtaaaccctgtctctactaaaaatacaaagaaattagccaggcatgttggcgggcacctgtagtcccagctactcgggaggctgaggcaggagaatggcgtgaacctgggaggtggagcttgcagtgagccgagatcgtgccactgcactccagcctgggtgacagagcaagactgtctcaaaaaaaaaaaaaaaaaaaaaaaaaaaaggcaatatttatttctcaccatcaggaatctaataatctaatataaagatcaagacgttatagatgcatctgcaatgtgaatttttaaacttgggtgcatgtgtatggagggtccagaaaaccaaactggcggttttcacagtggccaggtttctgatctcaccttaatttgctccataaggactgcactggttgcctctgtttcccgaagcaggccgtttaactgatctgcactttttgtggtggaactgagcttctgaaccaattcttctttggtaaattcagcatgccataatggaggctctgcaacatgttgttccaagaattaattttcaaaatcatacattacagatgaagattctaaataagaaaaatctaaatataaatatcttactatgtgatattttataggtctgctttctttgccattcatctattcaacatacctcaatcaacagattatatgttgtaggtgacacaaataaaacagtatctctgttgtaaagcatgtaatctaactgaatacaagccctatgagtcccagttctgaaatttgtcagaattgtgtttatagacagttttattacacatcttcttcccatctattaatattccaagattttatgtcatttcacgtataaggaaagcattaacatttactggtcacgtatcatgttccctcataagaatcttctatcaggcggggtaggtatcattattcaaactttacagacgatgaaacaggctcacagttgacaggtaattttttcagaaatcacaaagtcaaattggcttctggagtctgctgctctatcatgatgcctccgtgtcaccactattaactttgcctgaaggaaccatgacttgcagtttctaccccatgtggtcagtgaccatgaatacaaatgacccttactccaggtgattctgaagtttcaggaagatgacagattccccctaaattttgaacagtaatattaattacaggtaataaaatataccaaaacatcactacaaaaatttagcattacttcatcaagaggaataaactgaaactgtcagtttcttggaagggtgagaggatagtttatcctgctttctaatacccaccacctatttgtgactataaacttcccaccacttatttatggttcaagcctagggcaagagctagcattttattttaaaaaagatttgtttaataatttttccatttggacagtgtgatggttaatactgggtgtcaacttgattggattaaaggatgcaaagtattaatcctgagtgttgtctgtgagggtgttgccaaaggagattaacatttgagtcagtgggctggggaaggcagacccacccttaacctggtaggtgccatctaatcagctgccagcgaatataaagcaggcagaaaaacctgaaaaggcgagactggcctagcctcccaacctacatctttctcctgtgctggatgcttcctgcccttgaacatcagactcctagttcttcagttttggaacttggactggctctcgttgctcctcagtctgcagatggcctagtgatcgtgtaaggtaatacttaataagcatccatccatccatctcatccatccatccaaccatccaattagctctgtccctctagagaaccctaatacaaacaggtagtggaatattgaaagaaattttattggagcagcccaaaaaagcatatgtaccttagagtaatagtaattaaataagacagtgaaattaaagaagaagaacatatttagacagagtaacagaccaagtttagtttcgggagaattaagcagctgctctaaagactgtgtgtatgtgctggcggaagacacagactccgtaatcagttgtctccatgccttctccctcttcccgggttacagtgtgcatgtctagaagcgggaggtctgtgtttctcctttctcgaaggttcttcaaagactgctgagaggaaactgggcctattagattttttttaaaggttaagtgtgagattgttcaaaatctattgattcggccttacagagatacacaataaaatgaaaatatcaaatgataagagtagaggaattaagtaactataagtgaaaggtgtatgaagaattgctaaaacatttcctaaaatttagtcatcaaggccaggcgtggtggctcaaatctgtaatcctagcagtttgggaggctaaggtgggtggatcacgaggtcagcaagttcaagaccagcctggccaagatggtgaaaccctatctctactaaaaatacaaaaattagccaggcacggtggcaggtgcctgtaatcccagctgctggggaggctgaggcagagaattgctggaagccaggaggcggaggttgcagtgagccaagatcatgccactgcactccagcctggcgacagagcgagactccagctcaaaaaaacaaacaaacaaacaaaaaaaaacttagtcatcaaacttttaactacgttagtcattttaatagcagctataaattaattgctactagctaagataaactgttagataacacagctcataatatagtactacttattttttattaatttagagtagagggccaaactactgctaaatactggccaaaattaaaagactagattctagcaatttttcaggattaggtatttcagattgcggcatacttcttgaaacacacttgccgaaatctgcttggtagacatcctcaatcactgcccttatacctttacctctgcagcttcttaattgttgctgctcacacctacagtgctcatacagttaagagcccagaatccagggcacagaactaatcaattacgttgcctagcaagactttcctgtttgctgataaactatattttttctgagacagggtctcactctgtcacacaggttggagtgcagtggcacgatcttggctcacagcaacctctgcctcccaggctcaagccatcctcccacctcagccccacaagtagctgggacttccaggtgcatgccatcccgcccagataatttttgtacttttaatagagatgggatttcaccatgttgttcagactggtctcaaactcctggcctcatgtgatccacccgccttggcctcccaaagtgctgagattgcaggggtgagacaccacgcctggtctaaactgtaaagtttatcgggccctttgacatgtattggtttattgactcccaaaaatctgaagttcagagaaatttaatgactttgcccaaggtctcataactgagttagaaaccagaattgtaatctagatttttaaacttcagatttcatttattttgcatttcattaaattgccttagtcctgactgccctttctaaagcattttcctgggtttctggtaagctgactgcttattccactgctgattgctagattacaatctcttgtgcgacctttgccctggctgattacttcctttgttgattctttggcatatgttaaattcttctgaagttgcttttttaccctaataagtgaccgatagctgctaatgctccagtgacaatatttcccatgggaaaccaaaacaccatcaacttgctactaaaatactgcatcatcatggctgacatttttccatttcttcctggaagcagaatggaagatactgggtacggctgaactaaaactccaactaattgtaaatatgaaagcaaagaagctatattggttatgcaattctacacattcagtgctgcttgagtgtttctaagttccttgctctagctaatgtttctatttaaaaagtagacaaatttgatgactaacaacggagaacacgaaacaaatctggtgaataccagaattaagacatgtgtcagccaggcgcagtggctcatgcctgtaatcccagcactttgggaggccgaggcgggtggatcacgaggtcaggagaccgagactatctgagggagaatcttcaggttttttcttctcttttgctgtaacaccagtcaaaaaaattgacaaagataaggtattaagtattgacgttaatactctacctgaaaataaaaaccatggaacctatctataggttaaaacagcatactgataaaaaacacatatactttgatgcagagatgtacgataatcatgaattagaattagcatcctgatttagttttctaccaaaaaccctaagtgaacacagaatctatttaaaacgaaagaaaacaaaaaaatcttgtgtttacttaatagtcattgaaaagaattactacaaatttctagaatttaaaaaggttaaaaattttaaagtgttgcctaactatacttagcatacaatagtttaccaaaatatccatgcatttgcagcaattgaaaaaaatcttaaaacataagcaagtattagtatacatatgaaactaatccaaagccaactgtgattagttcctgtaaggaaagttaacaattgccaagaatggaaggtgactagagttgcatctagtttgcctgtgttcaagcatgatactagataaaattaaataaaaactgttactctatgggtagctaacactataaaatctaagaccattcatatggctgaaaacaacccatccccagccaccatcaatgcaaagggcaaaaaattagaaacagaaaaaacttctatatgcaacctgttctgatctattaatgtaaagaacaacttctggctaaaggagtttaataaagtaagccagttatgaagcatgccatgtataccaactggtgacagggaaacattctgagagctatggtgtccaatatggtagcctagccacattctattaaaacctcacaaggtggctagtccaaatcaagacatgctaacagtaagtgtaaacacacacactggattttgaagacttggtgaaaaacaataatgtaaaatatcattaatttttatattaattagaagttaaaatgatattttggacataatgagttaaatcaaatctatcgataaagttactttcatctgtttccctttttaactgtttctttttattctttttaatatggctactagaaaatttatttatttatgtatttatttgagatgcggtcttgctttgtcacccagagctggagtgcagtgatgtgatcatagttcactgaagcctggaacttgtgggctcaagtgatccctctgcctcagcctcccaagtaactgggattataggcacaagccattgcaccaaatgacaattttaaattacatacacaggttatattttatttctattggatgacactgctctgcagaaccagtgcccttccttttacaatgttaaatttgtccctctccttcattataaacgaaaacctagtatcatttcctagctaggagaaataacagtacaccgtaagatacagattcttgttccacttctgctattactcagtaaagacctcttgggtaaatcagatagcctctcttggcctcagtttactcatgtctaaagtcttcatttctaaggtcccttgggacaatgacattatcagattcaaaacagaataaggctctatgttctacagtagtgtataggcacattcgttcttaggtcagggattcctaacctagagctcacagaaactgtacgcaagtatacatccacttttaagttaacacttttcacatttctcaaagaccgtatctttaaaataaaagattaagagctaccttagctggtaataaaactggtatacttaaaaaaaaatcagagattgttattttatcattgtacttgtttggcatggctaagatgtgttactggtcactaagggtgaggtttcacttccctaacctgttcttgaaggccttcaacagatcccacttcttgttccactctagtagccacacttctaaaaatgatctgtgcaacatatataatatgcaagctgtagaatgctggctgttaaaaatggggtccattttcaaatacaacatttttctaaaccatgcacaaaagaacagccctacagggacactcttccatactgtatacatgccgttgccactacatgtgaatactggcagacgttagtggctaaagataaacattagataaaacataggtcttcactgagcagacctgaaatagcagagcaatgaagtacattacaaatcagcatcccagtacattttaaaaaacaaaccaacaagggtgtcatgccaccagtcaaaaggtactttgcttaaactggcattctttaacattcatgttgtagtggtaagtacttcatttcatacagccacagttattaatactttcctaagggctaccagctgctaaaaactgctgttatctcatactgagaatgctagttctatacctttgctctcaggctgtgaggaaggggtgctagtccaaaaggccatgggattagatttaaaaaggctaaaattaaatcctagaaaataaagaatatttcattttttaacattttaggaaacaaaatgaatatgcttttaaaacataaaaagccagaatccctcaatttataccaccaatctgactgtcttacatattcatttatccctgtagtttcattctttgctcatttaatacatgagcaagactgacatacaacacataaaatgagaacatctcaatatcatggttttttttgtttttttgtttttttttttttttttggagacaaagtctcactcagtcaggctggagtgcagtggcatgatttcagctcactgctacctccatctcctgtgctcaagcgatccacctgcctcaacctcctgagtagctgctaattataggcacgcaccaccacgcccggctcatttttgtattttcagtagaaacagggtttcaccacattggccaggctggtctcgaactcctgagctcaagtgatctgcccacctcaacctcccaaagtgctggcattctaggagtgagccaccgtgcccagcctcaatatcatgttttctgagtgacaaaagaaacagaacaaatgaaaatgaacactttaaaaaaagactcacgttaatgcgcatgattcaagcatgagtccgtacactgtaccaagttcttttgctctgccctagcatgatagaagtatcttccagttactgaaatgtctttaactaagttctcttgctctttgaaacctcaccgtgaacttattaagggagaaaaaaaattgctcaaatattttgggggtgttcacaaagcatcgtttatatcccaacattagtatcccacaaagagtctgcatcaagctaaacattaaaagaaagaaaaattgtgcttaactttaacaacaaagtacctacccttttctggtgttttaaatgtgtagttgattgaagattcttccattggaaaggaagcagagagatttttgactttgctatctgaagactgttcgatatcagagttctttgacagttcacattttttaggttccactttgctttcagatccactctgggctactgaactagtttcactatcgttacttttcaaaggtgcattaaaactaaatccaaacaaagacccagtggcagaactgttgccaaatgcaaatgggtttgatttttcactactaaaaattcttttaacagactctgaaccaaatacaaactttggaggagaaaccactgcttttgttgttgtttcagatgtgctagacacttcaacttctgaagctgcatctgctacatcatcaccctgaataacatctgtcctctctcttgtggtttcttctaatacagctacagcaattttgccacatggtgactctctgggagtgcttgaccgagaaacatgaggtgttatcaaagaatctttttcctgggctgtttttgcttcatcaaaaattttcttaaatgagtctgcaacatcctgtagtttaaaacgaacagctaaatgctctacttttctttctccatctgcaaaatcacatgcagtccacacccatactctttctgtccctttcatattttgcaaactcatgtctggagttattctgtgattggcacaaagttttaatacttggtcccttctcatcactatacgaacttgcttattatcataattctgtaaaatctttatatcaccaatgcccctttctttccattgaccaacatctttatcatatctgtagagttctgccatgtgactaaaaacaacttgttcattttcctcaccactggatacttcaactagatcaggtaaaggaacaacaggttcaaagtactgtccatctctctcttcttcttgagtaacatcagattcttcatcagtgccaactgaagtcccactctgattcaacttggcaggagacttagatagactcaaagcagatttaaaactgaagttaaatcctgttgttgactcatcaaagcggaaaatattttttctcacagggctacttgccaacggagaatcatgtactgagctactactaacattatcatccaaagcatcttcccttaaatcatagttatcccattctaatgtgggcccagtgttttcaggattgggttttattgttgtgtctgaggcaccggctgcacctgtacctgaacccttattttcttcctcagtgacttttgtttgatcatttgtcaaaaacgttttgaaatctttcagtccactcttcatttcttcagctctctgtattagcttggcagctctgccagtatctacaagtttatggggagtttgaagtggtatgtctaacagaagccgctggcattcctcaaatttctgcttgaattcttcagccagctctggtgttttaaattgtgctgccaaccgctctagtttggcatcaccatcagagaaatcactggctaaccacatccatgctctatctgatccagagaggggcttcaggttcattgtagttgttatccaatgattagcacacacttttagtacttggtctcttcgcatcagcattcttggtttgccattgacctcatttttgagaatttttaagttccccaagcccctttctttccactgacttatctcagcatcaaatctaaatagttttaccccctgtgaatacagaactttttcaccttcttctcctgttacaagttctactttttcaggcatttgaactactggttcaaaatggatgtcatcgctgtcctcagtcttacaggcatcatcatctttctcaaagtcaccggaagtgtttgctttattggccattttaccgcattgtgatgagaataatttttctccagcacctgaaaatcccttgaaattggggtcttttttgccaaactgaaatccttctcctgaagttgattttgcaacatctgcaaatgtaaaagtgctacttgtttggccaaaaatcacaccacggccattcttctggccactaatatcctgagcctggaagccagtatcattttcaagaggcttttcacttttcttttcttgatttcctggttccgaaatgccaaatttaaatccatcagcagacacagcgatggaaaatccttctttggttgacttaaattctgtattagaagaaccctgaaacataaatgaaggtgaattttcttgatccacatgcccaaaatagtcatgaaataaataccttcttcattcctaaacaatttatcaaatgatgttaacaataatgatgatgatgatgatgataacatttattgagcatttattaatgtgccagctgggcactgttctaagcactttacattattatctcattttaatatcctcaaaaaccctatgaattaaggtattattattaccctcatttcacatatgaggcaactgatgcattgagaggttaagaaacttgcctgtggtcaaaataagcagaagaacaagggtctaaatgcaccccaacactctgtcctcaaagctgtcacattcaactaccactgtaatattgagtcttcaatcaattgttatatatatagctgtatcaggcctgaaagtacttaccacatagtgggtcagcaagggcattacagttctatttctgttaaaacagaacgatgaaggatccaccaccaccactcccatttttaaaatattctaaatattcacacttattaacacaaaaataaggtgactaagaaggataatttctgtatttggagataaatttaaaatatctacattttaagggacataaaagttttaatagtgaactgctctcttgaatttatttgaaggaaccctaaacaatttaaaaagaaaataattataaatgtataaattattcctttgttacctttgtgggagtaacattagctgctggtctgagaagatactgggaattatatgctggtgactgactataatatactgaagggccagtagttgcaactaaaaaaaaaaaaagaaaagaaagaaaacactgttaaagtctatactacagttaagactatctaggcaagagctataaatacaaaagcaatagaaattaaagaaagatttaactacataaattttaaatttctgtacatcaaaatataccaatcaagattatcaaatgacaaactagaaaaaaattgctaaatatgacatgaagaataagagaatagcatcgctgtgatcaacaagaactacctcacaagcattaaaaaaggaataaaggagaaagtaactgttgccttttctaagaaagatcagtatgatgtggaattatggacattcagtcacagaaaggacgtaaggaaccaagatgccatctgatggtcaatgcatttgaagtgggcctagaaaatctgcagaaagactaggttgtattttgtaaactaaagctattactgagaatgttcagctcaaaaatcacctgacaaattcatggaaaggatgtcataaataacataaaatgtgttccctggcttaaaataaaaagcacatcaacactcatacagatgtacaaactgtctgctccctctgtttggtctgttttaccaggaaacaaaacgactagaaggcacccatgttaatgacaaaactaccaatagtcatttgcttgaactgttttatgatagttttaccagaaaacaaccaaaagaccttttatgcctgtacatggaagaagaaacagaaactgtgccaagaggttccaaacaattgcctctggaaagcactgaaaaatcaagacctagaaaaggctagccagaagcccaagtttgattttggaaaccttacagaggtgaggataactattttgaaattactatggggaggaagcaggcacagaacacagaacaacctgacagaaatggcccaagaatcttaaagtcttgcaaaatgtctgtctgcatgaaagcaaaaagaaaaaataaaatattaaataaaaaaaaaatcttagtctgaagtttaagtagggactttaattgactactgactctaaactgtgaggctctaataaatatactaaaagtaatctaattttttaaagcaccatatgaatagacaatttaggaaagaaatgttaataggcctcaaggaacatgtttttgaagtgagccttgaaaatctgcaaaatgacaaggttgcattgtgcaaattgaagctattatgagaatgttcaagtcaaaaaaattacctgacaaattcatgcacaggatctcacaaggaacacaaatgtgttcgttggctttaaaaaaatcacattaacattcatgttgatatacaaaaactcttctccatctgttttgtgtgagttttaccaagaaaccaaacaactggaaggtacccacgttgaagatggcaaaactaccaactgccatttgcatgaattgttgagcatgactagtattaaaaaaacttaaaaattgatataacttttgttcctacaaattggcaaaggattttataaactagtaagtcagcattagcaaaagtgcgaaaatggcactatcagatactagtggtaagagcataaactgaatattttgaataccctacaaaactaggacagtgtcctagaatttgtaatggcataaaccagaaacaacataaataaaggaacagaatttacagtacttccatgtgatgggacaccatgaactcattaatattcaaaaaacatttaagtttaaaaatgctcagaactaaagtaacatttaaaaaacaggctagctcatctacacacaacatagtaacatggtaacaatctcataaaaaatactatatgtatagagaaagaaccagaaggaaatgctctcaaatataagaaatgttaataaggtggttagtttttagttttcttcaccctgttcagtacttctgagtatctcctatgagctcattaatctttaattttaatcatcttattttaaaaaaacaaggaccatcttgatatatgtttacttttattaaggaaaaagaatctatgaacacaggaacagaaatcaggagatcttggctctcgccctttcagtgccacaaagctgttttgtgaacctgtaaataatccatttggagtctccatgtttctcaattgtaaaatgaggatatgctgcttctacacatttcacagggtcattgcaagaataaaatgagacaatgagaatgttggatttacatgcttgtataagaacagaagaccttttatgcctgtacacagaagaaatggaaatcatgacccacaaggcaccaaataactgactgcacacgtcactaaaaaagccccaggaaaggctagccggtttgtttatcctcttacaaggacctatatgatgtgtaaggttttaagaaaacaaggtttgaacgttagacatttcatatacttatctatgacttacgacatttaataagcttgacttcacaaagattttctgttattttgcttgtgttgagaagatactatcacaaaaggctagtggggttgccttaactataggaaccatcacacaaatgtgctcatctaaactagattttattctaaatctttcctgggctaaaaagagaaaaaaaaaagggcactactactaccatttcagaagtctgtcgtacgtaaaaggaacaatttttttatttctggctgcctgggagcaatgtattatactggcaagtgctttggagttacaccactggagtgtgaatctcggctctatcaataactagctgtataataatgagtaagttacctaacctttctttatccatttccttatttataaaaaagggattaataatggtaccggccattctaagttactgtaattaaatcaaattacattcacaaagcacttttgcacatagccaacccacagtaaacactattagtaaccttagttcattaactgtttactgtatactctaataaatgtctgatacacacccacgcccacctgcacatacacaaatgctcatagtaattatgtaaggcaagtattatctccacatttcagacaggttaacttacacagctattatagtaagtgatagagcagaacttaaaaaccctgtatgattcaggtccaaactccttttctttctttatataaccataatatttcaaattaagtaagatttcctatataacgtcctgcctctcatcattatcatcaaaataattccccagaggtgtaggttcttaattaagcatttcttagtgcataactctattcaataacatttttcaatttaaggaataatctcatctcagctcatctgaggtgtggattaagtgttctttaagcctttatatacacgtgatcacatacggctcgttttttctgcttgggattataaaaatctccgtaacaccaaatacagcttttgaagtcacatataaacagacgttgacatgtatattaacaaacatatataaacaaggtgatttcacacgttatctacttaaaagagggaagtaaagtagttttactaaaatatgcgattatgcacttgccagctcacctgttagtggagccccatgaaatgtctgtgacccctgatatccatcaggcaccgagtctggtccataattctctgtgggccaacgatgacgggatgctgacttactgctatttagtttctattggaagaaaaaaaaatcaaataattttaatcatttaattatatcatgccagaaacagtgctggggaaacttactcttttaaatttaaataactgattttttctttttttcttttttgagatggtgtctcgatctgtcatccaggctggagtgcaatggcacaatcttggctcaccgcaacctccacctcctgggctcaagcaattctcccacctcagcctcccgagtagctgggattacaggcgtcagccagcacacccggctaattttttgtataatagtagagatggggtttcaccatgtttgccaggctagtcttgaactcctgacctcaagtgatccaacacctcagcctcccaaagtgctgggattataggtgtgacccaccacgcccggacctgattatatcttttgaaagtttctatttgccaatgagttctaggtacctggtgctgattttaaaatatgattcttaatttgttaaaaatttatctgctcccattttcattcgttaatacaaaacctaattcattaactctctcacctaaacaaataacctcctaaatgatcacaccttcatttccattctacacttgcctacattaacctttctgacattcacctccagccaagacaattccctgctcaaaaaaacaagtacctacaaactaaacttctttccccaactttcacagtcctctaacattacactgaccatcctttcagtgtgttctttctatactgcaatctggactacctgacattccaaatcacctccccaaattagcttttcacttaaccccatgctgaaacaaaatacaactaattctccaggtgacgttcaaatgctccaccaggaaagggaaaaaagcagtagctgcagataatttattatgtatataataatacgtccaatgcacttaaactcttaatttttatactatctacactgttaggtaaacaatattagctcctatcttaaaatgagagaaagggatgcagggaataacagctggaatttgaaccacatctgactccaaaaatgttctcttaacacaactctgctgccttgacaagatggcagatagatacaatgccgtctagtgtagctatgtggctacctgatctctgctgaagaaaactaaatgacagcaccatacccaaccctagaacctacaaaatgtccccttacaaaacagacacttaacaggaaattctttttccaaagaaattgtagtggtatcagaaaacaggtaaattttgaaaagtttcaaacttctctgtatcagcccaggaatccgaccagttctaacaagtgaggtcagggacagatctagcatgtctgctttctttttctacaagtgtttcaaataaaaatttcccagaaagacctaaccatgaggtccaaaactatctcaattttcaagctaaataaaatttcccccactcatccatctacagtgcctagtccagatgctacacatacacatccaagaaataagaaactagtggaatcacctagaaaactttatggtcactgttggtatccgcaccagagctttgaatttgcaatcactgctgtaactgtaatttttaacattcagtgtaatgagaactggcttcaataattctctcattttaaagataagaagccagtcacgaaggaagtgactggcccaagatcattaattaatggcagagtcagtactagtaccaagcttttcaagctcatggactagtgctccactatacttccacagaatacaatgttgggagcctgaaacctgtatgttaagtcaaaattgtatgtaattgtcataggccatgactacacagaattaacattcaagatttttgtgcaaattcaaaaatgtcttccccaccaaatagtattctcttaatttgcaaatactgctgatcacactgtaataatcgccacacatcagcatatccttgatgtaactttagcagtataatttagttcttgcctgataaacatgaaagaacctacttttatttccaattccaaaaaagtcaagctcctttgaaccctattgttaaaataagatatatatacataactatttccttacataattaagtcaaattcatatggaagtattaaaatatagcaagactttttgaagctcagaccacttttcaattcctagctatacatttgaaacacatgtaatccacagctaatctgagaatgaactcatagaccagagtatgattagtacactgtagcagttcaatcactcgggaaccttctctgtgtcaggaactcttatattttaaataaaacagtttctacctttgaaggtctcaaattttgtggaagatgaggagagagacacataaagtactttcaaaaatatagtaaagggctgggtgtggtggtttacacctgtaatcccagcactttgggaggccaaggcgggcagatcgcctgaggtcagaagttcaaaaccagcctggccaacatggtgaaactctgtgtctactaaaaatacaaaaattagctggtcctggtggcgggtgcctgtaatcccagctactcaggaggctgaggcaggagagtcgcttgaacctgggaggtggaggttgcagtgagccaagatcgcaccattgcactccagactgggcaacagagtgagactccatctcaaaacaaaacaaaacaaaatatggtaaagggtcaagaccaaggtatgtaggctgggcacagtggctcacacctgcaatcccagcactttgggaggctgaagcaggaggattgtttgagccaggagttcaaggccaccctgggcaacatggaaaaatcccatctctacaaaaaatacaattagctgggcctagtggcgtgtgactctctgtagtcctggcttcgtggcaggctaagccaagaggctctcttgagctaggaggtcgaagccacagtaagctgtgatcataccactgtactgcagcctgcacaacaagaccctgtcttaaaaaaaaaaaaaaaaaagaccaaaatgtccccttgccatactatttggatggcaaggggacattctgaccagcttcagaaaaaaagtgagagagtggccagggaaggaatcttggaataaaaagtacagctagagaaattaagtgacttaccgtaatggcctttacttcttggcaaatcattttccgtaaagaattctgatcttctgcccatcgaggtggtgttttgggagaatactaaaaaaaaaaataaaaataacaaaagagcatttaaaacacttagaaacaatttcacaatgaaatgattccattctttcctgtttaccttgtaacttttacttggtgatagtgaatatttggtaggagatggtgtagaatgttttatttctgaatctgcatttcgcaaagaaccatttttatagagaggacctccttcactatagtcttcgagttcctgcatgactgacttaagcatctcttttacagactccaggggcacaggcaactaaaaataaaagacattaattaagggctttcatttgcaaaaaattccaaaagtaaaaactctaaaatgatatattttatcttatttacatttttgtcattttaataagcactttacactttaaataataatacacgtgaaagtgttttttaattatcttttttctttgtttttctgctgttttgtattattatttttatttttttgtctttattctatttttttcttcatgaacacagaaaagtgttgtacaatctaacatcttctgattctaaagtccatgctctttctattacttctgttaaccatgataattgtagaggaatgttaacttggaaagcttttccaagtgaacaaaataagttactgatgttttctaactgattttcaatggtgacagaaatacagatgctacaatacaccagacaacataaatcctaataaaagagtagtaacacaaattaatcaacaaaacactcagaagactgaacataatttaacatcatcatgacaatctcaaacagctgacagcaagaaaacaagggcgttcataatggctgatgaggatgagaagaaatgctcttaagttgtcagcaacaactttcaatttcagcaaagttcattaagaattagtcctgaggttataatatttgttttgattacactgctaagataacacctagattcccaagtttaaaaagacacaccaaacctaagacaaagcaagcaaatataagcatttagacacacacatcccttctgtgcattaataacaacatattactgagtatttttgaaattaccaaaatataagaccaacgcaaaaacactgaccagtgggttatcagtaagaacgtacatacaacaacctgctacttactttcttgaccactgaaagatttgaatcactgtcatctataatctttattaggtagtccctggtctttctcagataatttttgcattcttcttgttcttcaggaaaaacggcatcattttcaatgtcttctgctttcctgtgaaaaatctatacaaatagtgcttttatgaaatcattagctttttaaaacaaaaaactttcagcttggccacgcatggtggctcatgcctgtaatcccagctactcgggagctgaggcacaagaatcgcttgagcctgggaagcagaggttgcagtgagccaagattgtgccactgcactctagcctggccaacagagaaaccccgtcttttaaaagaaataataaataaataaataaaacttttagctcaagtactgcatctacttaccagtgcaagattccaataagaaacaacactttttatagattcaaaagcagtcacagcatcttctatatttccatgtactgcatccaatatagcaaaagttatgtgtgcatcttcttcatactcaacaatttctgatgcctaaacacacagaatagtttttagtcaaattgtttatactcagaatataaaacccaaatgattttccaaagattttatatgatcttaagagacaaacatctcattactcttctctgtcatatcttatctgtgagagctagtgaatttagaaaacaagattaccgttaaataacaaggcaattaatttaagcagtttatagctccacgtctttgtttataaactggaaattcccatctccaataaattcataaaggaactctgttacctgaatgtctacactatgaaaatgtttaaacagaggatcaataggttcaggaatactgttcttctttattatcttcaacaatggcaaaactttcttccaataatgaacacttctccctatgtattcttgttgatcataagaagaattaagacccctgccctaaaaaagaaagttaaaagcacacaactttaaggaacacgcatgattagatctaaagttcatttacaggttgtaagaactggctaaaatttcaagtcaaaaccaaatggtacctcaatagtcatttgttcaacttccaaatactgtaataactaaaccaccttaataccagtgaactcactgcaacctctgccgtgcaggttcaagcaattctcctgcctcagcttcccaagtagctgggattacaggcacctgccaccatgtctggctaattttgtagttttagtagagtttttttttgtatttttagtagagacggggtttcaccgtgttagccaggaatgatctcgatctcctgatcttgtgatctgcccgcctcggcctcctaacgtgctgggattacagatgtgagccaccgcacccggcctctacactcaacttttaaacacttctaatgataccaccctaatgtagcaatcccaactactttttaacagttgccatttttagatagctgaaacctgcctcttctgtagtgtcagtttgttcaaaaggctgaccatcttcacctaatggtgacacaaaacaaaccttaaatatttagaaagatctataatggtcttacctacaaagccttgtgctaatttttttttttaattttcaggctgaataattatcagaacttaattattaaggaataacagtaacagctcagctaatatgtaacattcactgtgtgccaggcattgctcctctaagtgcttatatttaactacattaactattttgcagcaataaaaaacacatctgtcataatatgaccaagctgctgttttctgaacaaaaaaactttcaataaaaagtgcatgattttaaaaaattaaggtaatgttctttaaaaatgcttatactttaaaactcaccattttctgaaggcattttgcccaatgtacaagcagagcaggttgaaggccatgtttttcctgggctcttagagtgtttatttcatgctgaactacaagtctcaattctgctgagtttccaggtctaaaaaatacttcaatttactaaaattgttttctaaatacacagttcagcgcttacatacatatatgttaatgggtcacatgacaaattaaatcttcacatgaggattaaatccccggtaaaacctacgcactaagtgaaagcaatatttttgttttactacttacactgcttttctgtgaatcagagtacaaaccgcatcccaccaagatttttgtctctctgtacaaagccgtttacacacaggaaggggcaggcataacggctgataggagctgtggtgagaattacatttctcctttaattgtaagtggctggtatatactactccaaggagaaatacctgttttatttaaggaaaagttaagttagaaaaaaaaattaaacaaaattcagaatatttaatttgttaaaatctttgcttacttcaagatctaaaatacatattgattcaggtgcatttgtttcaagccttgaggtttcctggggcaaatgatggaaaagctgttttagccattttcggattccaggtaaagcaggcaatgaattccactgtaagccaagccaagtaaggtgctgaagactaccattatgtgcttgaatagcacctgaaataaaataaaaaaattggcttaagggttcgaaatttttctttgtgccattagttttgccaacataaacaattcacattatatatatcttaattatataactgcttttctatatcaaagctggagggaattctatgttaggcaaaatctcatgttcttattaaatgcattctcacttgattatttctagaaattttaataaaaatagtagtgatgaagaatgtttaagtccatcttaaaaaatgacactgactagaactcaataaaccaaaatcaactgacaaaagccaaataaagaacacctaacctaataagaaaccccaaaacaatgggttttcctttaagtcattaaagcaatggaacaccactatattaatccatcggtacagtaaagaaatctgtttttctacaagaaagtcaatattgaaaaggttatgtgcagtcaggagttcgagaccagcctggccagcatggtgaaactccgtctctactaaaaatacaaaaaattagccgagcatggtgtcacatgcctatagtcccagctacttgggaggctgaggcaagacaattgcttgaacctggcaggcggaagttgcagtgagccgagattgcaccactgcgctccagcctgggtgacggagcgagactctgtctcaaaaaaaagaaaagaaaagaaaagaaaaggttatgcgcttctggaagcatgaagaggtataatctttctgtcattttggcaatttgcaagacttaaagatgttcatgtcctttgtctcagtaattctgtttttaggtatctctatggaaataacttgcaatgaagacactttttgttgaagtttttatcagagtatgattattaacagtggaaaagttgagaaaacttggatgcccaataacagaaagttgcaagcaaattatgactacttcataaaaaagattatattgccaataaaagtgatatttatagttttaatacagagactatgggagagaattcatgaaggaagcaagataaatcatacataaacaaccatttagatgaaaaatatggtcagatgcagtggctcatgcctataattccaacacttttgtttttgagacgaagtctcgctctgtcgcccaggctgtagtgcagcagtgtgatcttggctcactgcaacctccacctcccgggttggagcgattctcctgcctcagcctcctgagtagggactacaggcacatgccaccacccccggataatttttgtatttttagtagagatggggtttcaccatgttggccaggatggtctcgaactcctgatctcaggtgatctgcccgcctcggcctcccaaagtgctgggattacagatatgagccactgtgccaggcctaatcccaacactttgcggggcttaggcaggaggatcacttgagcctaggagttggagactagcctgggcaacaaagggagaccctgtctctaccaattaaaaaaaaaattatctgggccgagtggcatgtgcctatggtaccagctactcaggaggctgaggcaagagaatcccttgagcccagaagttcaaggcagcagtgacctacgatcacgccactacactccagcccaggtgacacagcgagaccctgtctcaaaatacaacaaggctggtcgcggtggctcactcctgtaatcccagcactttgggaggccaaggcaggtggatcacctgaggtcaggagtttgagaccagcctgaccaacatgatgaaaccccgtctctactaaaaatacaaaaaattagccgggcgtggtggtgggcatttgtaatcccgctacttgggagactgaggcagtagaattacttgaacccgggaggcagaggttacagtgagccgagatcgcaccactgcactccagcatgggcgacaagagcaaaacttggtctcaaaaacaacaacaacaacaaaaaatacatgccacccctacagcaccacattcaaactccccccagcccaacccacacacaaaaggaatacaggaaaatattaagtcgttatttctgggtaataagattatgggcaatttataataattaagacggagaccatttcctctgaaacatataacttaccaacatcgtatctagccaaatcttcaagctctggttcttgtacatcaatgtttccaatatcatcgctaccaagaaaagatgtatccttagatgactgactagaaaacagagcattatataacacagactgcccgcttttgttggcaaaagtttcaacaacctcttttaaaaaatcttgcttgccacgacttaagtttagcaacatatgccctgaaaaaaaaatttaagttatttccatcactttaaaaatacagattgtatttgctcacgttgtctcatttgtatacccaaaggggaaataacatgattattgcagacctaaccctccaacccaaaaaatacagctggacaacaaaacgggtgcttatgtagcaaatgaaaagagtacaggtttaatattctcagtatctacataagacagcagaagggggaaaaaagacaggaatgtgtatgaaaaatgccaaacatatttgcattttagatgaaaaggtctggatttaagtggccataggagaacagggacaagctcttattctctgatctgatacactgatttctgaacctggctgatcagaatcctcctttaaacagcttttaagaattatttccggctgggcacggtggctcatgcctgtaatcccagcactttgggaggccaagctgggtggataatgaggtcaggagatcaagaccatcctggctaacacagtgaaactccgtctctactaaaaatacaaaaaaaaaaaaaaaaaaattagccggccctggtggcgggcgcctgtagtcccagctactggggaggctgagggaggagaatggcgtgaacccgggaggcggagcttgcagtgagccgagatcacgccactgcactccagcctgggcgacagagtaagactgtctcaggaaaaaaaaaaaaagaattatttccaggccttgttcccagagatttttattccataggtttacagtaagcaatcaaaaaatcatagtcctcggataaaatactgatacatgctataacacagatgaaccttgaaaaccttgctaaatgaaagaagccagtcacaaaagaccacatactacatgattccatttatgtgaaatgttcagaagaggcaaaccggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaagaagaggcaaacctacagagacagattagcggttgccaaggctgagaggtttgggtaaaatggggagtaactgctaataggtaagaaattcctcatggagtgatgaaaatcttctaaaactgactgtggtgacagtggtaatactctatgaacatagtaaaagccactgaactgtacactttaaatgggtgaagcgtatggtacatgaattatatttcaattcaactttttttaaaaaccctcctttgagttaattctgctgggcaattaggtttggttaccactacacagttgtgtctcagcacacttacagaggcaccctcgggatgcccagatcaaagacataaaaaaaaaatacaggcaattttcatctaactgtgacaccatgcaaaggcacttatgagagccctgcaagggtagaaggaaaagagaaaaggaaaaaagtagaaagtcactttaaggactgaaagcctagctcccacaaaaaaagtgggctatggaataaaagagcaatgtgagctttggccaacagcctaactatacaccaaagcttataataactttgatttaatattacatcttgctctttacaaaattcatccaattttatatcaaaactgctccttataggaagcattatgtttcttcagttcactgcttgattcaatggccatctaactaccttaaagtttgtatcttagcaaaatcacaggtaatatgcaacagacctttaggattcatcccaagccaaaaacgggggaaaaaaatccacaaattccaagagcctaatataaggtaagtatatatcttctatcttcctcactatgctctcagctctttaagacagatccgtatcttcttcatctttatatccccacagcagtgtttttagaatcagctggtgttaaatggttggcaaatcaataattatacttagttcaggaagtgactaaatattcaggctagaggctctagcagccagatgaagaaagagttaagaaatcctctccacataggaacaaacaatatcaaatattcattttttttaaagaatgtgctatttcttcgcatctcttccatacctattgctcttaactgatacggcaaaaagaaataattttgacaaattatctcctggacagatgaagattttatcataagatatgccttaacagaaattcctttttctttttaaattaaattagtttaatattactattacctgattggctcagtcggtcacaggccatcatttccagcagattttgtccagcttcaccttttattaatttaatctttggtcttggaacctaataattttagaatcaaaaatcttaatttgatgatacccatacttctaatagtaacatggtcttgtctattacactgtactttttttgataatgaataaacagttaaccattaattaaactgaattggaaaagactgcaaaaactgggaaccaaggaatttatataacctatgaaagataggccaggtacaggcgtggtggctcacacctgtaatcccaacactctgggaggccaaggtgggctgatcacttgaggtcaggagttcgagaccagcctggccaacatggtgaaacccagtctctactaaaaataataaaaaaaaaaacaaagaggcaggcgtggtggcacacacctgttaattccggctacacgggaggctgaggcacaaggatagcttgaacctgggaggcagaggtcgtagcgcgccgagactgcgccattgcactccagcctgggtgaaagagcgagactccatcgcaaaaaaaaaaaaaaagaggggccagacatgttggctcacacctgtaatcccagcactttgggaggccgaggtggggggatcacttgagcccagagttcaagaccagcctgaacaacacggtgagaccctatctctaaaaaaagttttttttattagccaggagtggtggcacacaactgtggtcccagctactcaggaggctgaggcaggaggatcacttaaatccaggaggtcaaggctgcagtgagccatgatcatgccactgtgctccagcttgggtgacagagtgagaccctatctccaaaaaaagaaaaaaaaaaaaaaagcatacacagagcagctctgagaaattagtttctactaaaagcacattcgtgttacattcagagaaatggaaaatttaattatattacttttctgccctgaataaataggacaacagcagatgttgtcctatttgagtagatatgacaccctactttaaaaagtacaggtgaaatgacacttggaaatgccacattgtagataacacattttcagagtatggataacaggggatagcactagaataaatgggacaaccaggaaattaaagagatcctaatgcaataacctatggaaaaaaaaaaagcatgatgaatagaatggcgaagggaagacgtgacagctgccttcaggtattaaaattattttataaaagaaatcatcaaaagaagaaacaagaccaacaggtagaaggcttgaagaatatttttattctatataaggaagtaccaagagccaaaccacctaaagatgcactgggctatcttgaaaagtaatgaatgcccatcactgaaaacgtccagtcacaggcaatgcccacttactagaaacatgccaaaagtaactatatgggtgactagagcatcggcttttaattctatcaccactttcttaattggtggtggaaatgtaatttgatacaacctctttagggttagatatttggcaacagctctaaaaattataaatgcacagatatactttgatactgcaattctttcaggaattcatggcacaagttaatcattgctaaattacttgaagtagcattaaaaaaaaaagtaaaagcaagctaatgtcctggttttaggaccctggttttaaaaactccaaaactacagtacatccatacaatggaataatatgcaagcatccaaactaatgagaatgccctttatatatactgacatggaaacatctccaagatacagttaatggaaataaagtaaatgcaatgttcaaatgttttcctccttcctttaaagacaggggatatatgtgtgtttacttggagatgcataaaacatttcctgaagaacacacaagaaagcaataacattagtttctttggggctggagaaagtaaataactagggaacagaaaggagtcttcatagcatattcttaagagccgccagaattttaaaccatgtatatataattctttccaaacatgctcatttttcaaaatatatgatttatgaacctaaaagcttctgattttgaattttagaaatattcatatcgcctatccttttactcacaagttttctaaacatcatgtcaaagtttgtcatctatatgttgaaaagagcacacaaagtaagaaacaaaatgttgacatcattctttttgttttcaaactgacctcaattcataaacccggcctcttttacaaaattattcaacagttgaatctgtgaccagttaattagttgtgaatccactcaatcaaatcatctcaattcactatttcctcttttttttttgagatggagtctcgctccgtcgccaggctggagtgctgcagtggcacgatctcggctcactgcaatctccgcctcctggtttcaagcaattctcctgtctcggcctctcaagtagctgggactacaggcacctgccaccatgcgtggctaatttttgtatttttagtagagatggggtttgaccatgttggtcaggatggtctcaaactcctgacctcaagcgatccgcccgcctcagcctcccaaagtgctaagattataggtgtgagccaccacgcctggctatttcctcatcttaactaaaaggtttcaagatactttgttaactacctagctgcaatgcagatgcacttactagaaccacagtattcctctgattaagagtctgaaaatcttgccataaaagttagccaattcttaaatacccaaatgccagcacataacctacattttatgcttataatcatttgttcattaagctttaaaataaactgatcaaataaaatacaagcatctaagatgtttctattatatattcattctacagaaatatgtggtagctaataaagactgaggtaggtatctctgtgctgaagtggaacaatgaagaaacattcagaaaagcaaggcatctggcaataggtaaagcacacccacattgaggcacaatattttttaaaagcagagaaagaatgtattgcacatttgcatatgcaaaaaatatttctgaacacccaagaaactcctaacagtagctgtcatctaggaaaggagacctgagtgaatggattaagagggaaactaacttattatgattaaaagttcacagtcaggtgtggtggctcatacctgtaatctcagcactttgggagggcaaggcagaaggatcacttgaagccaggagttcaagaccaaccagcctgggaaacatagcaagaccttgtctttacaaaaaatttaacaatgtagccaggcatggtggcaggcacctgtagtcccagctactgagctgaggctgaagcaggagaggatcacttgagcccaggagttcgaggatgcagtgagctatgatcatgccactgcactccagccagagcaagagtgagactctgcctcccaaaactacatatcgaaaaattttaggctgtgcgcagtagctgacacctataatcccagcactctgggaagctcgagcccagttcaatgttacggtgagctacgattacgcaactgcactccagcctgggtgacacagcaagactctaatagacacacagacagataaattttaaagtttccattaaaaataagaactattggcagggcgcggtggctcacacctgtaatgccagcactttgggaggccaaggtgggcggatcatgaggtcaggagatcgagaccatcctggctaacacggtgaaaccccatctctactgaaaatacaaaaaaattagccaggcgtggtggtgggtgcctgtagtcccagctactcgggaggctgaggcaggagaatggcgtgaacccaggaggcggagcttgcagtgagccgaggtcgtgccactgtgctccagcctgggcgacagagtgtgagactccatctcaaaaaaaaataaaataaataaaaataagaactatcagttacttgagaatttctataagaaccttttaatgtttgtattacctagtgaacctcactaaatccattaattttcactaatccattccttatgaacacagaagtttctactgagccaatattagcatttaacatgtgaactgtctatcaacggtgtttttaaaagatttacaggccaggctcaatggctcatgcctgtaatcccagcactttgagaggccgagtcgggtggatcacgaggtcagaagatcgagaccatcctggctaacatggtgaaaccccatctctattaaaaaatacaaaaaattagccaggcatggtggtgtgtgcctgtaatcccagatacgtgacaggctgaagcaggagaatcacttgaacccaggagacacaggttgcagtgagctgagattgcgccactgcactccagcctggtgacagagcgagactccgtctcaaataaaaataaaaagatttatattaggcagggcatgctggctcactgcctgtaatcccagcactttgagaggccgagacacgcagatcacctgagttcaggagctcaagaccagcctgaccaacatggagaaacctcatctctactgaaaatacaaaattagatgggcgtggtagcgtgtgcctgtaatcccagctactcgggaggctgaagcaggacaatcgcttgaacccgggaggcggaggttgcagtgagccagatggcgccattgcactccagcctgggcaacaagagcaaaactctgtctcaaaaagaaaaaaagatttatattagaaggaggggccttctctaaaagtaatgaatccttttttttccctccccaagcaaaaaatccttctctaaaattaatcatttttctaagcctggtttaatgctttttttggaagactgcttatttcttttcctttcaaaagttatgcaagctcattaaaaaaaaaagtccgggaatggtggctcacgcttgtaaatcccagcactttgggaggccgaggcaggtggatgactaggtcaggagattgagaccatcctggctaacacggtgaaaccccgtctctactaaaaatacaaaaaaattagccaggcatggtggtgggcgcttgtagttccagctactcgggaggctgaggcaggaaaatggtgtgaactcgggaggtggagcttgcagtgagccgagatcgtgccactgcactccagcctgggcgacagagcgagactccgtctcaaaaaaaaaaaaaggccaggcacgccaggcacagtgcctcgggcctgtaatcccagcactttgggagaccaaggcaggtagatcacgaggtcaagagattgcgaccatcctggccaacatggtgaaaccccatctctattaaaaatacaaaaaattagctgggcttggtagcacgggcctgtagtgccagctactcgggaggctgaggcaggagaatcacttgaacccaggaggtggaggctgcagtgagccgagatcacaccactgcactccagcctggcaacagagagagacttggtctcaaaaaaaataaaaaaataaaaaataagaaaaggttttatgttttcaaagattaatagatatactgttacatatacacaatacagccataaatgttatatacatgtgtttcaattaacatgttaaattgcaatcatattcttctatcataggctataaagccattgccctacatctacttattaggattttgtccaagtaacacacctttttgaatcaagctttacccataatacgagattacatctttatcatgttcccaaaaatggcagagtaaaaagatcaaactcttcaaatttgtctacaaacaaatcatggcaatgcaggctttcgacaagagtgcactcaacatccctgtttcaccagcctcaccagtattgtgtatgcttagttattttccactgtatcaaattgactatttcattttaattccacagtttgttcacatattgtcattacataccagagcacaccttcatttaaaacacatcaagactccgtgaaatgtcaattgctcctacaagtggaagacttacctgaaatgctatgacatagcacaatgcagccagctcagaaagagcttgccattgaacattattaccatgctgacccatcttcaagagcagagaaccagcatgcatgtagaaatgtcctttcatttctaagaaagtagctgacagttcatcatttccacccaaagaagattttgcagactgaagagcactatcaaaactgtaatatgaaaatatcaaacagatgatacacacttactgcactgtgaataatcatggttcatttaattcaaaacaaaataaaaattttatttcaagcttcatcttccacattcaacttctaataattcttattccccatgttataaattatgaatcatctaatgcttatttttatcctgcatacttcctatacttcatgcttaacctctcaaatgatgtcttattcccagttatttccagccctccaatcacaggataaatataagattagtgattataggtgcacatttcaaaataaaccaggataaagttgggagactattttgtagtttcttcctgatcatataatttcattatttaattaacagttgtaatttctcaaattagacataccatttccaaattataagtaagtaactgacaggtatttgagtatcaatacagcaattgctctttttactatatagatcattacagcgttaaattgttttttttttttttttttttttttgagacagagtctctcactatcgcctgggctggagtgtaatggcacgatctaagctcactgcaacctccacctcccaggttcaagtgattctcctgactcagcctcctgagtagctgggattacaggcacctgccaccatgccccgctaaactttttttatatttttagtagagacagggttttactatgttggccaggctggtctcgaactcctgacctcacgatccgcccgcctcagcttaccaatgtgctgggattacaggcatgagccactatgcctggcctattatttgtaatctatattctaaattagttcttctaaatcctaatgtttctccaaatcctcactttggaagaaaagtaaaagcaaaaagcaaacacttaaacgtgaagcatgattttaaagtggcttacaataacgcaaccagagcaaatgaggtctaaagatctctgagggtgctcaaaaaccccttcaggggatccatgaagttaaaattacttttacaataataccaaaaaaaaatttatatattacatactcattttctcatgtatgtagagctgagtttttttgtttttgtttttggagacagaatctcactctgtcacaaggctggagtgcagtggcacaatcttggcttaatgcaacctctgactcccaggttcaagcgattcttctgcctcagcctcccgagcagctgggaatataggcgcgtaccaacatgcccggctaattttttgtatttttagtagagacaaggtttcaccattgttagctgggatggtctcgatctcctgacttcgtgatccacccgcctcggcctcccaaagtgctgggattacaggcctgagccaccgcgacccgctgagctgagttttctagaggcttcatgacatgtaatagttttacagactgaaagaggaagtaaatgagaatctagctatgttctattaagcgagacattaaaaagatttacaaaaatgcaaaaacaatgacacttttctgactacttttttgctgttggaaaataattatttttcataaaaaatgctattattggccctgcgcggtggctcacacatgtaattccagcactttgggaggctgaggcgggtgggtcacctgaggtcaggagttcaagaccagcctagccaacatggtgaaaccccatctctactaaaaatacaaaaaattagccaggcgtggtggtgggcacctgtaattccagctacttgggaggctgaggcaggagaatcgcttgaacctgggaagcagaggttgcagtgatccgagatcacactgttgcactctagcctgggcaacaagagcaaactccgtctcaaataaaaaaaaaaaaaaaaaaaaaaaaagctattattattaacacacaatagggcttattacatttttaatggattacattttttatttgttttaatttctaatgtaataaacactgacagaaataacccacatacggccaggtgcagtggctcagacctgcaatcccagcactttggaaggccaaggcaggcggatcacgacgtcaagagattgagaccttccagtactttgggaggccaaggtagacagatcaagaggtcaagagatcgagaccagccgggcgcggtggctcatgcctgtaatcccagcactctgggaggctgaggcaggcggatcacaaggtcaggatatcaagaccatcctggctaacacagtgaaaccccatctctactaaaaatacaaaaaattagctgggtgtggtggcgggcacctgtaggcccagctactcgggaggctgaggcaggagaatggcgtgaaccctggagacagagcttgcagtgagccgagatggcgccactgcactccagcctgggcaacagagcgagactccgtctcaaaaaaaaaaaagatcgagaccatcctggccaacatgatgaaaccctgtttctactaaaaatacaaaaattagccaggtgtgggctgagcgcggtggctcacgcctgtaatcccaacactttgggaggccgaggagggcagatcacgaggtcaggagatcgagaccatcctggctaacagggtgacactccgtctctactaaaaatacaaaaaaattagccgagcgtggtggtgggcgcctgtagtcccagctactcaggaggctgaggcagaagaatggcgtgaacctgggaggttcacaagggggggtaacaaagggcccatgagtcctgattaactgatctgacaaaccatctgtcacccaccaccctaagccacactgtgaaactgcctagggtggcaccagctttttatcttcctcagggtcctcccctcaggcccccaagtcaccccctcatggtccggattctcccctgagtgactccatccccatggtcatctcccctcctgagcctccccctctgagggccaagggctgtcctcagggccctcctggggcttcctggtggggaacaacctgaggcaggaggataagctcttattcagagcattgagaggaaattgtgaagcttgcagtgagccgagattgcgccactctactccaggctgggtgacagagcgagactctgtctcaaaaaaaaaaaaaattagccaggtgtggtgtcgggcacctgtagtcccacctattcaggaggcagagacaagagaatcacttgaacccaggaggcagaggttgcagtgagccgagactgcaccactgcatgccaacctggcgagagcaagactcagtctcaaaaaaaaaaaaagagagattgagaccatcctgaaccccgtctctactaaaaatacaaaaattagctgggcgtggtggtgtgcgcctgtggtcccagctactcaggaggctgaggcaggagaatcgcctgaacccgggaggcggaggttacagtgagtcaaggtcatgccactgcactccagcctggtgacagagcaagactccatctcaaaaaaaaaaaaaaaaacaaaacaaaaaagaaagaaagaaagaaaaaaaggaacccacatacaaagatctttgatgtccttaagaaaaatgtaaaaggaacttgtgaccaaaaaatttgagtatacaaagaacacaaaataaaacatcctacatgttttctaaaataatcttaaagttatgttagttcttttagatactgctcttaccctaccaatttaggacactatgtactttttcaagaaaattacctactccctgcactcagtgaaatgaacttctttccttataccagatggggaaataaattaacttccaaacaaatggacagcctaaactagcaatcagtaaactttttctacaaaaaggaggagattactaatctggctttacaggcatacaatctctgctgcaaccactcaattccaaccttgtagtatgtaagcagccacagacaatacataaacagaggcatgttgcattccaataaatattaacaaaattaggcaggggccatatttggcccacaagttctaaccaacccctgctctaaactaacatttttatacaaatccaagtgatgtttttgttcaatggaatttattttcaaaatggagacactggttttcaaaatcaaaatttaggaaaaaaggtaaatcacatagttgagttattttgtttcttagctaaaacagtattttctgaaataccagtgatgctaagtgcttatactagtacatgtgaacctagccatctgatgacagatgaaccttaattttcactcaagattatactattataaaaaataaaatatgaaatagcagttagaacattcattttaagcttgactatgacaaacctgagtatttaaccataaggctaattttaatcaagcttgaactataagagttctctaaaaaggaaagtcatataaaaccaattagaacttccccgtaaaagaagaaaaataagattgcctcctagtggttcactgtattaactataactcctaggtacattatagaaataatgatgcagtaaagaaatttagagcaatgaacttactgcaaaaagaaaaactacaatttatactaaagcattctcctcaaagtcaacgcacctttccagtaattctctactttcctgcacatctctagtggaaagcgtaagaagcataagattagcataggccagcagtaagtctgtattggttgctcgccagtcacttttatcagactccaaacactgtaaagactccagatattcctattttgtggaatgaatagtaagttacaaaacttaatcaagtgttaagaaattaaccattttatgcctacaaattccttttctcactctaaccacgtttgtgaaactacattgatttttacatcaaccttataaatgaaaacaccaaaaatatatacatttatcatagttatctccccaactttcccattataaatttaactgatcctggtaaaaatttcattttataactgttctacctaaataaaagaaatttaagtcctgcggggcactgctgctttagtacaaaaagatgtatgctaattgcctacatagaaatgtaaagacccaatagcttttatctaccttaagggtctgtacaacacacgaattccactctaaacttgaacgcaaagctatgttcctctctgcctcatggcagcgggccacagcatccttcaatcttttatttgagcgatacaactccactagccggatgttcatatggacgtcatcaggtcttacataaagttctgactgaatccagtcaaaaagtttattccatccatcttcaccttcacaatctagaagatgttcctatttagaggggaaaaagaaaaattattagagtaacacttgtgcaattttaaacaagtcatgctcccaaaaagcaccattccactatgtctagttttatgatgatgccaccaaaaacaccatcctatataccttattcgtcccttctgagagttgcttacaacccagaaactaagcctcaagaactgtatgtgaagaaaagcatctgtgattactgcagtagcttatactctcttcagagactaccaggactattgccacacatccctgtccatctgagtcaccaccagaagcctagacctccccagtcaatcctcagcaacaaggtccttatgctcaaactgctctgtatctccttaaatctgactcaatcccacatcccctctcctcccactgttctgttaccttcatcatcatctcaaagcactgtcatcacctcctgatcttaaatgaagacagtatcatctcaggataacccccactaccatgatggctttttctctctgaacttacatacaaggagaggaagtagggtttgtggccactcgcttctcatttgcgatgctcttccatcagcctctcaagaagctaggaccataggcatgcaccaccatgcccggctaatttttttttaacgttctgtagagatggggtcttgccgtgttgcccaagctgactactcagttccttaatcacctcatctccagtcatgttatcctctactccaacctcaaccatccacttgccactgacacaggtcttcaaaatctgcattttggtcataccaccgaaacgaccataccatccttcttattcttccacctcactgagggcctacgtacccttactttcagaaatatacttctccaccacatgacaagttcccttcaagacaataacatcatcaagttttaagcacctgtaaacacatataaatacacacactttcttctgtcaggcaaaaaatgctataatcccttatatccataattactgtttgcttacagatcccttcaactaattccctcttttcctcagaaccctcccaactggtttctgtgtgcttagatttgggaaatcataaccccaagctaaccgatttcatttgcattatctcaaccatcaaactggtgctgcctaaaacaaaatgccattttagtactaacagactcactttctccactccctgacacttcacacctcctcctatttcctcaacttccccataccttcctttgaccctcactttcaacttataacctagattcatccttcactgagaaacctgatgctatcacatataaattccattttaccttacctacttaaactcgtctttccccagctctcaagaccaagccgtccattactactctgtatttcattcccctctctcctttatcaatttctcctcttctggatgagatggatgataccctggtctctccctattgcaaaagccctagtctttgactctatgttaaacattttttaaaaaaccactatgagtgcttttaaaaagttctatctcatacttgagagaaaaagccttctcaacagtaatactctcattcattaaacaaatgtcagaaactgtttaccttagcaagccttaaattttaggagaaatggaattactttgcatgacaattataaatctcatggatttcaattccaaaaaaaaaaaaaaatctgatacaggaaaggtgttaacagtgccttcaagttattaaagaaaatctttaaagagtgcttcaaagtatctaacttgttacactgcaagaaaacaatctcctgccattacatatgttctttaacactactgacaccagattaactggattgccacgcccaatatgggagttatgtttgaggcataacacctaagagagtaaagaaatctgcacaattagacctcatgttttagactaatatttaaaatccagctgcttattactggggagaaaaacttatcagtaatatttatctttggaagcatcttcaatgctttttcagcttcaaaaatctggacatgattgttcatagcagttgaacaacagccaaaacctagaaataaccaaaatgcccctcaaaagtgaatggttaaggctgggcacagtggctcacacctgtaatcccagcactttgggaggccaaagtgggtggatcacctgagaacccgggaggcagaagttgcagtgagccgagatagcaccactgcactccagcatgggcgacagagcaagactctgtctcaaaaaaataaaaataaaaaaagtgaatggttaaattgtggaccatgaaatgctactcagaagtaaaggaaccaactatggatatacaaaacttaatatggatcacaaatggtattatgctgactgaacaagccaacctcaaaaggtcacatgcttggctgggcgcggtggctcacgcctgtaatcctagcactttgggaggctggggtgggcagatcacatgaggtcaggagttcgagaccagccaggccaacatggtgaaaccccgtttctgcaaaaatacaaaaataagcgggacacggtaacatgtgcctgtagtcccagctacccggaaggctgaggcaggagaattgcttgaacctgggaggcacaggtggcagtgagccgagattgcgccagtgaactccaacctgggcaacagagcgagactccgtctcaaaaacaacgaaaaaagaaaaaaaaaagtcacacatttcatgatgacatttacataacattttgaaatcaccaaagtataaagatggagaacagattaatggttgccagaggtcaggcatagtgaagagaagtaaatagcatgactacaaaaggggcagcatgaggaagatctctgtggtaatagagtagctctgtatcttgacagtagtggtggtatgaatctacacatgataaaatgaaagaaaactatatacatacacattgtaccaatgtcaaaattcctgattttgatattgtgctttggtcgggttaaacaggttgagtatcccctatccaaaatgcttgagaccagaagtatttcagattttgaattttttcagactttggaatatttgcaggatacttagcaggcagagcatcccaaatctgaaaatctgaaatccaaaattttccaatgagcatttctttgagcatcatgtcagtgctcaaaaaatttcagattttggagcatttaggatttcagattttaaatgctcaacctgtataagcattggggaaaaatgaagtagcatataggatctttctgtgcaatctttgcaacttcctgtgcaaaaaaatctataattatttcaaaattaaaattttttaaatttctatcagaaacatatacaatgggggtaggaggaggctaaaggcaaatatacatttataattttatattgtacatacacaataaagtatacattaatatataaaatattacaatatacattttaaatgtttgccaaacatatttgtgtagattttctccagaacagttacttagtaaactatattttgctctataaagaatatcaggaccagtcaatacactagcaagaacttcctaccatttttagtaattacatcttatatactagagaaaccaccttttatcttttccttgaaaactttactatctcaaaatacaatcccttctactttcagaccatagttattagaaaactcttctttaaaatatccctaaattgtcatcctgtaggtaattttcacttaatgaagcaaaaattgtataccagacagaacttaatgtaaatcttagctctacttagtttacagctactaaactgtaaaatccctaaaatattaattattccagaagggtaaatgagatgtcacttataaagtataacaatgcctaataagacagcagatgctcagaaaggttttaatacactttttaaaagaaaaatgttaaaggaaacacaaacacctgggcttaaggtttgctattgaaaagtaatttaaactccaaatattagaaatggttatgtcttaagttttctccctttatgttttgtatgtttacctttagtttataaattgcaggacttcctgggaaaagtttcgctgccctttcaacccagtattttgctcttccatcagtaacatcatttttacaaagcaattctgcaatcttcaacacaagatctttttgtggtgggtttaattccagtgaacgctaatatcagaaaagaaattaaagattagtaaataaattgtatgtatgtatgtaggagtatatatacttatatacttatatataaaggttaaaaattatcactccaacccttaaaaaattctacttctagagaaaacatgttacttcaaaggtgttaaaataaaagtgtcttggaattttctggaaatgaatcaaataaaaattatatttgtgtcatttgaatgcaaaagaacacaaaagaacaccatttctgaccatgttagacttacaatttataggtgttaaacaattctaaatctgttccaagctgtgtcacataattgtactatgataccaatgcctgttttatgatattcataaaatatatttgacttacttatataaatttctctgggcatcatgtgtttggctatgcaaaggctatatttgaatcctataacttaccctgtaacattcaacggctttctctgtgttttcttccaattcataaagaagacccagaaatctgtgagctctgggatccctctcttgcacactaaggtaagtacatacgtatctgtttttcaaaagtaatacaaaagtaaattaaacttagaactgtacttttaaatgctaaccgaagaatacatcttaaaccaaagcaaccactaaactcgtttatattgttactcaaaactaccactatttatgcagataactcagaagtattcatagaaagaaatgggtaatacttaaaaacacgtacatagagttgaccacatactcgttttaccattaaatgtcacatttaccaaatttttctccagtgttatccacgcataagaaatgaacatataaattgctttttcttcctgatcacattttaataaagcactaacagttttgcaaataaattagaagtgattatagtaaacatttttaaagttatcataatgcaaaatactaaacagcaacaatttcccaaacaacaaagggaaatacacctaccctttaagcaagaaagtaatttctaacagtactatatccagctaaaatcgaacagaagacaaattactaattacagtaccaaatacaggaaatttccatttctcaaatcaagtaacaactaaaataagtaaatatcctctaggttccttgacagtattaccatcagagaaattaggccagacccaaactaagggattaaagtctcacagtaaaaaggtacaagagttaacagtcacagtgctgctagttacataatttatgtaccaccattttcctttcttaccagcatttccatcttcctttggatgcctttaaaagcctgcctcccagctgggagcagtaacacacacctgtagtcccaacagtatgggaggccgaggcaggcagactgctgtgctcagaagttcaagactagcctgggcaacatagtgacacctgtctctaccaaaaaatgcaaaccttagccaggtgtggtggtgctcatctgtatccccagctacttggggcgctgaggtgggaagatctcttgagcccagaaggcagaggttacagtgagcaaagatggagccagctgctgcactccagcctgagcaagagagacagatactgactaaaaaaaaaaaaaaaaaaaaaaaaaccctgcctccctcttaatttcctgctttaatccactcccagtcaggaaatcagaatcaccaagcttcttatccctaggatagagccttagagcatcacatattgtgtcaattaaagatcttttatacaagctattctcctgccttacaattacagttttttattcattgctattttccatctgattaaggtatcagatatctaaccaaaaacaaatgaagatataggcatggtcctcttttactccaacagaagacaatttttagaaaaagtgttttaagccaaacaatttcttgcccttggtataaagcagcagcatgcagaaaacactaattacggtttcaatctcaatggaatctaggctggtccttagcatcagtctgagtgataaatcccttattccagaatacacttaggaagaactactaagaacatatttttacctatttcaaagaagaaaatgagaaaaggcattgattttaaaaaaagaatacatgttacagtttgtacttactttttagcaagatcatattctttagcttcataatacagctttgcaaaatagaatcctctcaacttctaaaaaaaattaaaagttgttttacgtttcatacagaaatattttccaacattttttcaaaagtagtaaaaatctgccctaagtttatgttcaaatatgccattttcattcacttaaaagttttttttaaagcctgacaaatgcataattccatgttttataatttcctatcacaaaacaaaaaatagagctgggtgcagcggctcatgcctgtaatcccagcactttgggaggccgaagtgggcggatcacctgaggtcaggagtttgagaccagcctggcgttataacatggtgaaactccgtctctacaaaaatagaaaaattagccaggcatgatggcgggtgcctgtaatcccagctactcgggaggctaaggcacgagaatcagttgaacccaggaggtggaggttgcagtgagccagaggttgcagtcagctgagatcgtgccatcgcactccagcctgggcgacagagactccatctcccaaacatcatcatcatcgtcatcataaataagctgggtgcagttggtcacacctttaattctatttaattctagcactttcagagaccaaggtgggaggctagctttgaggccaagagtttgaaaccagcctgtgcaacacaacaagatcctgtctccagggggaaaaaaatagccaggcatagtggagcatgcctgtgttcctagctactcaggaggccaaggaaggagaatcacttgagcccaggaggttgacactgccgtgagttatgactgtgacactgcactccagcctgggtgacacagggagatcctgtctctaaataataaatacataacatacaaaaaataaattcaagaaagcaagacaagcagacaacagaagttaagaattttcatcagccttggaaatcttggaaaccctgtggtaccactctctcacttaacaaacaaaagaaaccagctttctttggggaggaaaggtattccagaaatctcttctcctaccatgtgtaagcctctatgggaaagaataagtaagtacttacgatctattaaggcactgaggattccctgtgccttaatagtacatgtactgttctctctacagatcagatcagtattttacagtcaaggagtcaaaaaggcagaaataaatattgaattcttcaagtaataaacaaggtccacagcctggctccttggttacgtaaactccaaagtccaaaatgctgatgcacaccaggctgggtgcggtggctcacacctgtaatcccagcactttcggagactgaggcgggtggatcacttgaagccaagagttcgagaccagcctggccaacatgcagaaacctcctttctactaaaaatacaaaaattagctgggcatggtggcacacgcctgtaatccccgctgcttgggaggctgaggcaaagaatcgcctgaacccgggaggcagcagtgggccaagaccgcaccactgcactccagcctgggcaacagaatgattccatctcaaaaaaaaaaaaaaaaaaaaaaaaagctgatacaaccagagtatgttccatccatgtgataaagagtatacagccactcaaacatcttatttttgaaattccaagaccccagtgaatgtccaaaacgatgaacagtatcaaaccaggttgccatcaatcgaaacatgtttcctgtttgtgtcctccacccacaaatttaatgtcttgtccatctcaacaaagcacttatcacacactgtggctgtaacttttgcagtttggggtgtcacaacaaaactagcacaaatttctttttccttcttcacaatttcatggacaaaagatttgttcttaccgtagatcttagcaaccccagtatacgatcttttttctttcctaagtcaaaaactcacctcttcacttaaaggaagcactatatggcttctctctggcatatgtgaactgccagcatcgctattcttgctctttggtgccattttaaataaaataagggttacttgaacacaagcaccgcaatactccaacaactgatctgataactgagatggctagtatgtaactagcgggtggggagcacatacagcatgaatatattggacaaagggatgattcgtgtcctgggtaggacggagcaggaggctgtgagatttttatcatgttattcagaactgtttgcaatttaaaactcatgaaatgtttatttatataatcttccattcaatatttttggaccacgggtgacgcaggtaagtaaaaccacgtaaggcaatactgtggataagaagggactactgtaccagcaacgaacaatcagaaaaggaaattaagaaagcaattccatttacaatcgcatctaaatgaaaaaaatgcctgggaataaatgtaaacaaggaggtgagagacttgtatgcttaaattacaaaacgttgctcaatgccaggctaacacctgcaatcccagcactggcgacagagcaagactccatctcaaaaaaaaaagaactatagcaatcttaacaaaaataatacacaacagtcaggacagcacataaaggaacaaggcttgttccccgcttcctttttttttttgagatggagtcttgctctgtcgccaggctggagtgcggtggctcgatctcagctcactgcaacctctgcgtcccgggtacaagctgggactacaggcgcacgccaccatgcccagctaatttttgtatttttagtagagatggggtttcaccatgttggccagatggtgtcgttctctcgaccttgtaatctgacttcctccgcctccgaaggtgctgggattacaggcctcagccaccgagcccggccagttcccccttttcaaaatgaagaaatagattcaaggtacaatgccaaaacataatagaaaaataattccattaccttctttgcttccaactatgttattaaagtagacaatcttaagataattaaacaactttacaaattattcttctgtatgatcttttgcctctaacctcactttacaagggaactgaagctcaagcaggcaaatgccttgtttaaagatatacagctaggaaggagcacagcccacgttatgtaaacaggacaatatctgattcaagcagtacttctttacatgacagcagatgtcactataagcaaatacctgaattcacttaagctgccaaatatcaagaactgatgcagggctgaaaacaggaacagtaagaccctaagagatgccacatcatcgctatcttgcacagtaagatagagatgtaattgtaattgtccaaaacttaacatttgtggcctactttttcattatgcagttctaaatttctctctctttttttttaattcaaacggagtctcgctctgtcgcccatcttgcacagtcaaatgaatctccctccccctaaaatcctccaaaaaagctgctgttctcaacaaacccatctgatcagctccaaatctgtggagtcccaacaagggtgaaggccgtgattatacaggacaatgaggaaaagtctagatactgaaacatgaattccccagtcttcttcccctggaacataagggtaaggaaatctctcaaaaggcagaacaaacaaaagaggagaataagagaaaaattagagaaactccagctttcaggtaaacatcattaaaaaaaagggtaagaaatggtcaaagaaataatacaagaaacgctacagaactgaaagaaatgagtttcccaattgaaaggacacttccagaaaacctttgttaccaagaacaagactctcatcagactcctaacaacagaacttctggaaaatggagcaatgctttcaaaattgcgaaaaaaattatttcaaactcagaattcgataaccaaatgatcaactaaattaagtaaagatgttttaaagacataccattagtttccagaccagcctgaacagtatggtgaaattccatctctactaaaaatagaaaaaattagccgggcatggtggcgcacacccgtaatcccgctactcgggaggctgaggcaggagaatcacttgaacccgggaggcggaggttgtggtgagctgagaccatgccactgcactccagcctgggcaacagagcaagactctgtcccaaaacaaaaacaaacaaaaaaacctctcatccacttttcctcaaagcaagtgaactatgctacaccaaaacaaagaaagtaaatgaagatgacatgagatacaagaaacaaagggtctaactcagaaaaaagatgaagggaattctcaaactggtgataaagggaagtcccaagagcacagctgtgtagcaaagaggaagaaaaaccaatctgggttggagaagtcggttagtaagggtattccaggtagacagacaatcaatcaatcaatcaatcaatcaatgttttaagctgaaattgatcggattatgtgaccagtttgaccacatttgagggtttaagttgctgagtttaagtaaccaagtagtaacacaacatacaagcaaaccaaaaaataaagcaattattcagtccaggaaaaacaaaactgcacaacaagggcaattcaaatgcaaaatatttaccttatatttatataaatgttaaatattcatttaaacaaaaactccaataacagtactgaaacaatgaggggcaaagcaaagtgtctgaggacagttttggaggagcataatagccagtacagaatgtctaaagtggggccgggcgcggtggctcacgcctgtaatcccggcactttgggaggctgaggcgggcggatcatgaggtcaggagatcgagactatcctggctaacacggtgaaaccccgtctctactaaaaatactaaaaaattagccgggtgttgtggcgggtgcccgtagtcccagctacaggctggggcaggagaatggcgtgaaccccggaggcagagtttgcagtgagccgagatcgcgacactgcactccagcctaggccatagagcgagactctgtctcaaaaaaaaaaaagaaaacaaaatgtctaaaatgggagaaagggaattcaaaataacaaaagtatatgtgtgtgttactcagaagcatgaagtatagatgtaaagggcagaaaaaaaaactaacagctgtcaaaggtgcctgcctgtagtcctaagtactcaggcaacagaggtaggaggatcatttatgcccaaaaatttgatggcagcctggacaacacagcaagaccctattctaaaaaacaaataaataaaaataagagctgtcaagtagagtttgagaagtaggaatcagctgcagaataagaaaccaacttgacagaacatagaaaaactaaacagaagccatctggaaaaagaaaaactagagaaagaattatatatttttttatttttttattttttggagacagagtctcgctctgtcacacaggctggagtgcagtggcgcaatctctgctcaccacaacctctgcctccagggttcaagcaattctcctgtctcagcctaccgagtaggtgggactacaggcgctgccaccacgcccggctcatttttgtatttttaatagagacggattttcaccatgttggtcaggctggtctctctgcctcccaaagtgctcggattacagacgaagaatatttttaagaagggcaaaagcacatgtgagggagtagaaaaatggcaaaacaagagaagattaacaaatgaaagcacaatggaagactagaaagatatgatatacagacgcatcatcacactccaaaactcagacattctagaaagcatgggcagttcacagatggccagcctctgccaaactgggggagaatactaacctctttatattcttcacagccactgcctcttctccctccattccttaccttctatccaaagcaccctgttttgtcatttcactcaaacctaactttacagaatagcttcacatgttccaaagttactcactagttaatccatattccgttgaaatccccaggttctaatgtaaatgactttaaatttgggggaaaaaaaaagactctaagtgtaagagaggtgaggccgaggccgaggccgccgccgccgcccggccaggccgaggccgccgccgccgccgccgccgccgcccggccaggccgaggccgaggccgaggccgccgccgccgccgcccggccaggccgaggccgccgccgccgccgcccggccaggccgaggccgaggccgccgccgccgccgccgccgccgcacattaaccttttaagttaaagattaagagaaccaacacctctttacagtgaaatgccccaactaaatactaccgtatggcccaccataattgcccccatacttcttacactattcctcatcactcagctaaaaatattaaatacaaattaccatctacccccctcaccaaagcccataaaaataaaaaactatagtaaaccctgagaaccaaagtgaacgaaaatctgttcgcttcattcattgcccccacaatcctaggtctgcccgccgcagtactgatcattctatttccccctctattgatccccacctccaaatacctcatcaacaaccgactaattaccacccaacaatgactaatccaactaacctcaaaacaaatgatagccatacacaacactaaagggcgaacctgatctcttatactagtatccttaatcatttttattgccacaactaatcttctcgggctcctacgccgaggccgccgccgccgccgccgccgcccggccaggccgaggccgaggccgccgccgccgccgccgccgccgcccggccaggccgaggccgaggccgaggccgccgtcgccgccgccgccgcccggccgaggccgaggccgaggccgccgcccggccgaggccgaggccgaggccgccgcccggccaggtcgaggccgccgcccggccaggtcgaggccgccgcccggccaggtcgaggccgccgcccggccaggtcgaggccgtcggtctcttcgagatccactcacctttccaggcgacggggcggagccctgcaccgaggcgaggtaccgctccccgtaggctttgctgcgcctcatcgcaccgccaacctggctcccgagacgcgtgaaaccagcgctcagccccgcagcagtcgccaattccaacaggaaagcgcctgaaagccactgacgtagccggcggaggaccactgtgacgcacttgtgtactgcgtcagcactgtgtatccttggcgacgtcggcgctcgagctgcactcggccgggctcttggcagcaccctgtgctctgagggtgtcttgcccgccgggcgccgtggctcacgcctgtaatcccaacactttgggaggccgaggcgggtgctgtaaaccattcatttgcttatttcaatattttcatttgtatgctttcagataagctgaacttgttccaatctgctatacataggtttgtttatatctttacagtaaatatctcagttaagaattattttctctttgtaaagacattgtgactcagatactacttgtaaagtctataggaacacacagctagtaaatggcataattgaaattcaaatggaaatctgattctaaaatatacttgtagcaacatagctgattcctgttactgtatctgctcctgtaaattttgtaaattcattacaatttttaaaatataaaatattttcatatatttatttagtctttgctaccatgaatagcttcaatgggaatgatgattaattctagaatgtgcttgtcttttacatttctatgatttttagggttaaaataaaccttgttggtttacaaatgattcctgaatgatttctttcctctaaatgctacagcacttcactacaaggtctgcaaagaagctatgtgggggagtgaagtaggaggtgactgagattatgtaattaagttcatatatgtcataatttttcattgttcccactgttttagagaaaagtaacaaaggagaagacatgtgggcgtgtagagaaatgcaaggtggagatattaatgctacagtataatcttctgtgggtgtttagcctggggatgagaaaactaaggagaaccatgccagttgtgttgaaatatttgaagagctgtcatgcagaagagagaatagacttttttctgtaggcccagagggtataactaacattaagggaagaaagtcatagggtagaaaaattttattcaatttaaggaataactttctaatagtgcatagtattggaacaggtggctgcataaagtcccacgaagtgttcattctaatgctgaatacccatgcaccaagaatcctgtggaaatgatgcttgcagggattaaagaatgaagtagaatctaatctaatatagcctcttcctactagaatgccaaactcagaaagactttctctctgttctctctttctctctctctcgtgctctctttgtctaatttatctgtatacctatttaatttccaaaaaatgagattgacaggaagtgtaagagttaaaaagaataatgtgtgtatgcgtgtgcatgtgtgtgtgaaaaaatggattttaaaggtattggatgcccgttgagaatgtttatattcctctaccccttgaggtttatggttagcaaaaaaatagtaacaaagataattttgttatatcttattgtatggcagaaggagatttccatagtagaataaaaaaaacttttaaatcagagataacctgggttcaaattccaactttctcactttcagctttttgaccttgaaaaagtaactgaacctttataaaccttcatttttttactataaaatttggataataaagtaccttaactgtagggttactgagaaattaaatgagacaagtcacatgaagcacactttatattgcctagtatgtagacagcaataataaatcctggcttcatatatttccttactttagtttacattgtttttacaaacgtatcacatcagctgatagaattttgatgtcgtcatttaagtttctggttatctggtgtagaatgcaactgtttttctgatttaagataattcaatcaacaaatttttcttgagctccaattttgctcattctacctttctctccatgcaaaaagaaagtgagaaatgtcatttcatttggcaatggttaaacataggcaaacctttagaaatatttctttattttaaaatttgtgcttgtaaaatacttagttataatatatgtttactaatttactgttttttaaagttgttttattacggaaaaacaattttggtgctatacaccccagagaatactttaatgctcaattatctgaaaaaataatctatggtatgctttttcacagccctgctgaattctaggtactcttcctcgaatttgtgtgagaaaatatgtagactcacagtttacttcagaattaaaaatattactacagaatacattcaaattttatacctctgattgcagcatattgaaatgcttaagaagttccattagtgcagatgatgacaactatgtatgcaaaagtaccagagaaattttatgtgtgtttttatgcatgtatctttgtgtatggttacagtatgatcgtggcaaatgtataagatacacacatgttacacttttcatgcctgattaattcataaaaggcatgtgtgtgagtgtatgtatgtgtgtatttgcttatgctcactttctgtgcttgtctaaataatgaagatttttttcctgtatctatgctttcagaaaccatacctgactaactggtggggaatgtgtatttacattttgccactacactaattatttctgattaaattttctagttgcttacgtaaatcatgaattggattctcgtgttaatttgactaaaactaccaactagtaaatattttcaattaagtgattttcttcataattcccatcaatgattctttgttcttgttttttaaagaatattttgattaaaatacaatagtgtcattgtaaaatgattgacaagtataatgaatgaaataaaaatagttgaagatttttaaaccaaaacaaattcagtgataaatgttaatatattttattctagttgtttgtatgtctgtatgtagcagataaaagaaaatctccatgggaattgagatgcaaatgagattgagacatcattaggataaaaatgttagaatcatgaatgtcagaaaaaaaattagtacctggtaaacttgaggaaatctttgtactttccaaagataaaaagaaagttgttgcaaatcaatttatttttattccgaaaagacaaagtgatccagctgatatacagttatagataaatgcatgtacagtcatacagtgtatatcctgatgctttatataatatgtgacagcaagcttgtctttcttctttaataattgttgaaaatttaatttttgtgaccacatggtaattgattacaagaagggactatagtgtgtttatttattcatttcttgaacatttccattgctttctactttaaaattgctttaacagtgctgcagtgaagatacatgtactcaaatattttttaataattctactaattttcattaattatattcctggaaatgcatgtagaaaattaaatgatatagatattttaaatattcttattaccatattacttgattatttttgccacattactttctagaacagttgtgtcaatctgttttcttgttgggaaggtaaaatgcaaacattagatgtctagaacccaataaaaaagacaatgtaaacaagttgtattagtttgttctcacaccattatgaagaaatacctgagacacagtaatttaaaaaaacaaaaaaacagaagtttaatggactcacagttccacatggctggggaggcctcaaaatcacagtggaagggaaaagaggagcaaaggcaagtcttagaaggcagcaggcaagagagtatgtgcagaggaacggccctttataaaaccttcaggtctcatgagacttattcactattgtaagaacagcaagagaaaaaaaacccgctcccatgattcagttgagtcctgtcaggtccatcccatggcatgtagggattatgggaactaaaattcaagatgatatttggttgaggacacagccaaatcatatcattctgcccctcaccccttcctttcaaatctcattttctcacatttcaaaacacaatcatgccttcccaacagtcccccaaaatcttaactgctttcagcattaactcagaagtccacagtccaatgtgtcatctgagaaaaggcaagtctcttcggcctgcaagcctgtaaaatcgaaagcaagctggttacttcctagatacacgggggtgaaggcattgggtaaatacacccaaatgggaaaaaatggcaaaacgaacaggctacaggccacataaaagtccaaaattcagtgaggctgttaaatattaaagctccaaaatgacctcctttgactgaaggtcccacatccaggtcacactgatgcaagaggtaggctcccacagccttgggcagctctgcccctgagactttgcagggtacaggctctctcctgggtactttcacagcattttccacccctgctgaaaacttctgcctggacatccaggcatttccatacatcctctgaaatctatctagagattcccagcaagatcaccatctacatctgagaccacctcagcctggattttattgttcatttcactatcagcattttggtcaaagccatccaacaagtctctaggaagctctaaactttctcacatttttctgtcttcttctgaaccctccaaactctttcaacctctgcctgttacccagttccaaagttgcttccacatttttcagtatcttaatagcagtaccccactctactgataccaattgactgtattagctcattctcatactgctatgaagaaataacaagactgggtaatttataaagaaaaaggtttaaaggactcacagattcacatggctggggaggcctcacaatcatgtcagaaggcaaaggaggaagaaaggcatgttttacatggtggaaagcaagagagcatgtgcaggggaactgccctttataaaaccatcatatctcatgaaacagtcactatcacgagaacagcactggaaaaacccacccccatgattcaattacttcctgcttggtgtctcccatgataaatggggattatgggagttacagttgaagatgagaattggagtgggacaccgtcaaaccatatcacaaatagtagaaaaagacctacagcacattaacatagttgcgttaccacacaggctttaaaattaaagttatttttgcatgaaataaaacacgagaaatatgtttttgcatgaaacaatgaaaatagtcaataaaataatggaaagtatggtaacttaaataattggattcatgagaaataaccaaataaatattctagagattaaaaatgcagtgtctcaaacttaggccatataaaatatgtttaacagcaaacaggacatggcagaagacaaattagtaaaatggaaaagatatcaatggaaaatagtcaatatgaagcacagggcaataatgatttttttttactggacacagtgtaaggaaaatgtgagcacattaaaatatctaacatatatgttgttagaggtacagaaagagaagagagagaaaatagagcagatgtaatatttgaatatgtaataccaaaaattgatagacttcaattgacaaattcaagaatatgagtgaaccccaaccaaaataaaaacaaagagaaccccatgtatatgcttagtcaaattactgtaagctgaagtcaaagtgaaaaaacatatcttaaaaaaatagctgtgatttgggaagagacatacaatgttactttcaaatcagccacagtaatactaacaactagattattttccataagaaatggagccagaagacaatagaaagttattattaaaatactaagtaaaacaaaatcctaataaagagaaagacctaccaacctatgatagtatccctaataaaaatatcactcaaactgaaagctaaataaatcattttcaaacaaaagattgatgagataattcatcagcagaactgctaagtgaatttctcaagctgaaatcaatgatgataccacatgagaagcagaatcacagtaaaaaaaaaatgaagagtattagaagctttaatatataaataattataaaataatattttaataatattgttaacacagaaacaacaaaatcttggtagatttataataaatatgtatataaatatatgacaaatatcacaaaaggcatggaaatggtgcgaatagttatatatgctttgtaaaatttgtgcagttttataaaaatattagtactactaaaaaatggttgattataataactaggaatgcattctgtaacctaaagatgttaataaaaattaataaaagaatgtacaagtaaaacttaatataatagaactaattgtataagaatgatgattaattgaaaataaataaatttaccaaaaacaaagaagaaataatgaaacaagttgcaaaatggttgacttgaacctacctatgttagtaattgttttaaatgtacatgtactaaacactctaattgaaaagcaaactgtcggaacaattagaaaatacaactagatgctgtttaaaaaggacaaatattaactacaacaacacagaaagtctggaagagaaaggacagaaaagatataccacacaatctctaaataaagttactgtaggtaaatataaactatatcaaaatatcagaccatgttgaaagtaacaacttttattctttggaccataaacccacacacagaagaagattattaaaatatgcatttaacaaaagattttatttagaatagataaagaaatcctggaagtcattaaaaacaagataggcaattaaatttaaaactaaatggtaggctggatacagtggctcagtcttgtaaacccagcactttgggaggctgcggtgagagaattgcttgagtctagaagtttgagaccatcctgggcaacatagcgagaacctttctttaaaaaaaaaataaaaattagccaggcttggtggtgtgtactccagaggctgaagtgggaggattactttatcccaggaattcaagactgcagtaaactacgatcatgccactgtactctagactgggtgacagagagtctagtctctgtctataaataaataaataaataaatataacatagtaaaagaacctgaacaagactttcagaaaatgatatgtacatgaccaataagcacataggataatgatcaacgcaactagtcattaatcgaatgaaaatagaatcacaatgagacactactacagacctactgatgactaaaattaaaaagacaaataataccaaatgttgacaaggatgtaaaggaactgacaatcccatattttgccagtggaaatataaattgctgtcagtttttcagaaataattttggctgtttctactatatctaagaatacatacatctggtgagccagcaatttcactccaagagaaatgagttcttaccttcaccatgacatgagcaagaatattcataacagttttatacattatagccataaacataaactgccagttaaacgaggagtttgaggagattttggttgaaaagtacaaagatttagttagaatgatgaataagttccagagcactattgtacagcatggtgactgtagttaatagttaacataatgtatactttaaaattgtttatagagtagatcttacctgccttcaacaccaaaaaataataagtacgtatggtgatggatatgtttattagcttgatcccgtcattcctcactttatacatatataaaaatatcatatatgcttcaaatatatatatagttttttgttaattatagcatagtgaagctgaaacaagataaaataaaatgtgggggagttttaccatatggagaagctggtaatagcacaataacaataataataacagtaataattgttatataacccaaatatttcaaagaatgaatgatagttaaaagctacatatcttatattacaattttagttatactatttatctaaagaagccaaagcttaaatataattaattgatattttaaaaagtaaatacttttatcgggaaatgcagaaaagagagcactttccagctttcagtagaaagccagcattgtcctgacatcaaaatctgatacgtaaattataatagaaaactacagaaaaatgtctgtcatgaatatagatgcaaaaaaatttataaaacattaggatacaaaatccatcaatttataaaatgtatactacatcataaccaagtggattttttacctggaatttaatattggtttaatatttgaaaatcaatcagcgtgattcaccatgaacagagaagcggagaaaaatcagaaaattagaagtgcatttcctttatctgataaataacatctaagaaaaccttcaatttatatcatatttattggtgaaaaactgagctctaaaccggggaagaagaaaaaggtatctgtgcacaccatttgaagtcaaaattgtaatgaaagccataacaagtaagacaaggttgaaaaaatatgcaaggcctcagcctgagaagcaagaattaaagctctccttatatgaagattacatgatcatagatgtagaatatagtaaaaaatgcacagaaaatctactagtgctagcaaatgacttttgcacatattcaggatacagtgtgaatatatagaaaaaatagattttttgcttactagtaacaaacaattggaaagatttaaaatatcactcaaactaacacaatatgaaacaattggatatgaatttaacaaaatacatgcaaaaattatacactgtaacacataaacattgctgagaaaaagttaaaaagccataaatgagtggggaaagatattgtattcatgaatttgaagttccaatattgttaagatgcccatattcataaaatgttacatagatttattgtaatctcacacgaacatgaggatttttaaaaaaatggttaagtggatttgaaacttataagaagcaaaagacctataatgcagaaaaacaattttgaaaaagaagcccaacgttgtaatactaacattagcaaattgaagactcaatatataactgctgtatatgatcaattgattttctgactaaggtgctaaggtaactaagtatggaattaataatatgtcaacaaatagttctgagaaaaacaggacatctgtagataaaaaaatacatatttacatttatctcactccatatacaaaaatgaactggaaatgcatcatagatctaaatataacaaccaaaattaaaagcttttagaaaaaattgtaggaagatgttgctgactttgaggtaggcaaagggttcttagacatataagaacaaattctagtcatagaagaaaaatgatctgatacagctgaaaacgtcactataagaattttataatacaatcagaaatatcaacaagagaaaggaataagcagaggaaagaatctcagtgttcaaaaaaatccgttctttgaatcaactcagtcagacaattataaagaaaaaagaataaaaagaatgattaaaacctctgaaaaatatgggattacgtagacaccaaacctatgactcattggtcattgtgttgtgggaattgagggactagagagaccaatgtgtggaacaggagaattttatttaggtgaccactggctcagtgaactaacatccacaggctgagccctgaacaaagacagggctccacttttatacatgcatctgaaaagggtgtgaaatctgtaaggcgggtaagcaagcttacagaagcagaacaaaggcagtttatcaaccagtgacaggttttacaactcaagccaggtgttgcaactcaggcatatcttgtgaccttcgttgtgctgcacagaagggaaaaacaggaacttacaaaacttgcaaagataattgtgagaatagtaagggggaaagtggaagctgaaagagaaaaacttgtttttcccaaccttgctctgggtttggagggagagactctggagcccattccttcttagccttggctctgcagatagtgctatcaaagcctccacagagccctgcccttccctgggtcttggagtgagtgagcctagtacagaaaaacttgtttttctttttatatcttctgcttcaattggtgtccttgaaagaaagtgagagagagcaaacaacttggaaaacatatttaaggatattgtacacaagattttcatcaacattactatagaggtcaacattcatatccaggaaactcagataacccctgtgagataccatacaggatgaccattcccaagacacatagtccttgatcctccaaggtcaaagaaaaagaaaaaatattagtgggaactagagagaagagacagacaaatagagaaagaaagaaggaaggaaggaagaaagaagaaagaaaggaaagaaagaaagagaaagaaaaagagagagagggaggacggaaggaaggaaggaaggaaaaaaaagaaaagaaaagaaaggaaaacagaaacaaaatatcaggccaacaatggaccattcagcagaaaccctacaagccagaagagactggggacctatattcagcattgttaaagaaaagaaatttcaaccaagaatttaatatctagccaaactacacttcataagtgaaggaaacattaaatatttattagaccaagaaaatgctgagagaatttgttaccaccagagctgccatataagagttccttaagggagtactaaatttggaaacaaaaggccctaaccagctattgcaagaatcattgacaatgtaaatgaacaacacaatcaagtcatcataacaactagcttacaacacaataacagaattaaatccacaggtatcaatattaacatccaatgaaaatggctacatgctccacctaaaaagcacagagtgacaaattgggtaaagcagccaaacataactgtatactgccttcaaaatagccatctgacatgcaatgacacccataagctcaaagtaaagaggtagataataacttatcatcaaacagaaagaaaaatgagcaagggctgctattcttatttcagacaaaacagactttaaaccaacaatcatcaaaaaggacagagaagagcgttacataatgataaaagtttcaattcaaaaatatgtgactattctatctatatatggacccaatacaggagcccccagattcatcaaacaagttcttagagacacacaaatagacagataaccacacggtaaaactgggagacttcaacattccagtaaaggaattagacaaatcatcaaagcagaaaactaacaaagacattcaggacccaaatttgatacttaactaaatagacctaacctctaccaaaccttccacccaacaacaacagaatatacattattctcatctgcacatggcacataccctgaaattgaccacacagtcataaagcaattctcgacaaattcataaaaactgatatcacaccaaccacactctcagaccacagtgcaatataaatagaaatcaatatcaataagatttctgaaaattataaaattacattaaaattaaacaacctgctgctgaattactttgggtaaagaataaaattaaggcagaaatcaagaaattctttgaaactagtgaaaacaaagatacaacgtaccggaatctctggggtgtagcaaaaatagtgttaagaggacagattatgacactaaatgtctacatcaaaaagttagaaagatctaaaattaacaacctaacatgacacctagaagaactagaaaaataagaggcaaccaacacccaatctgccagaagaaaagaaataaccaaaatcagagttgatctgaaggaaattaagaagggaaaaataatgcaaaagatgcaaaaaaccaaaacttggtttcttgaaagaataaataagtttgatacacttctagttagaataatgggaaaaataagaagatttaaatagaaacattcaaaaatgagaagaacacattactactgactatacagaaatacaaaaaaccctcagggacaattacaatcacatctatgcacacaaattagaaaacctagaagaattaaataaattcctggaaacacaaaacctcccaagatttaaccaaatgtaaattaaaaccataaacacacctctaaggagttctaaaattgaatcactaataaaaagctgatcaaccagaagaagcacaagaccagttgaattcacagtcaagtagtactaccagacatataaagaagagctggtattaattctactgaaactgttccaaaaagttgaagaggaggcactcctccctatctcatcccataaagcccacatcattctgatacccacaccagtcaaacacactgcaaaaaaggaaactttaggtcaactttcccaataaacttagatgtaaaattcttcaacacaatacaaacaaagttaatccagcaacacatcaaaaagctaatccaccatgatcaagtaggcatcattcctgggatgcaaagttgggtcaatatatgcaaatcaataaatgtgatgcatcacataaacagaactaaaaccaaaaaccacgtgattatagatgtagaaaagactttcaataaaactgaacttcctttgtgttaaaaacccttgacaaactaggcatcaaaggaagatagcacaaaatactaacagccatctatgacaaacccattgccaacataatactgtacaggtaaaagctagaagcattccctttgagaaccagaattaaacaaggatacccacttttacaactcctattgaacaaagtattggacatcttaggcccattctatttccgcagaagaataatgagatgttcaacaaagctgacgataagaagcaatgggaaaaggattctctattcactaaatggtgctgtgataactggctaaccatatgcagaggattgatactgaattacttcatttccccatatcccaaaatcaactcaagatggattatagacttaaatgtaaaacccaaaactataaaaaccctagaagaaaacctatgaaataccattctggacataggtcctggcaaaggtttcataaaaaaaaatccaaaagctactgcaacaaaaataaaaattgacaagtgaacctaatgaaactaaagagcttctgcacagtaaaagaaaccgtcaacagaaaaaacagacaatctacagaatgacggaaaatatttgcaaactatgcatccaacaaaggtctaatgttcagaatctataagacacttgaacaaattaacaggcaaaaaacaaacaaccccatttaaaaaatgggcaaaggccatgaacagacacttctcaaaagaagacatatatgtggctaacaagcatatgaaaaatgctcaatatcactaatcataagagaaatgcaaatcaaaaccacaatgagataccatctaataacagtcagaatggctattatcaaaaagtcaaaaaataacagattctggtgatgttatagagaaaaccatttgacccagcaatcctattcctgggtatatacccaatggaatataaatagttctaacgtaaagacacatgcactcatatgttcttcacagcactattcacaatgggaaatcaacatagatgcccatcagtggaggactggataaagagaatatggtacatgtacaccatgggatactatgcagccataataaagaagaaaattgtgtcttttgcagcaacatggatggagctggaggccattatcctaaatgaattaatgcagaaaaagaaaccaaataccacatattctcacttataggtagaagttacacaatgagtacacgggaacacaaaacatggaacagtaaataccacagcctacttgaaggtggagggtatgaggagggtgaggattgaaaatccacctactgggtactaggattattatccagatgataaaatgatctatacaccaaaccttcacaggtactcccaaacctaaaataaatgttggaaagaaaaaaaaaacacattattcctcaagagtgtttacacaaatagcacacttactgtaaaagccagaaaatggaaataactgaccaatgaagaaataaattgtggttcatccatatggtgtgtactgaatttaagagtatccccttcaaagttatgtccacccagaaggtgtgaataggatcttatttggatataggatctctgcgtatgtagtcaagttaagatgtggtcatgaaggattagggtaaattctaatccagtgactggtgtccctataagaagagggaaacttcgacaccaatatactcagaggaaaatggctatgtaaagacagaggctgagattagatttatgctgccacaacctgaagaagagcaaggattgatggtaactcccagaggctagaagaggcaagaaagaatattttgatagagcttttggaggcaatatggacttgccatactcattgattttgaacttttattctccaagaactttgagatgataaaattctgttatttttagctgcacagtttgtggtaatttgttatggcagccttagaaagtagtacatagaggatgttacccagaaaaaacataaatgaacccttgatatacaaaacatggatgtattttaaaaaaaaaatttaaaaagaagttgaaatgaaaaatgcatgtagtatgatgtcctttatatacagttttagaaaggtaaaactgttaataagataaaggagaccagtattttcctttgttcagatgtgtgaggaattcactgcaaagagcatgaggtagttttatgagaaaaaaagaaatactcaatatctttttctatatagttattgatgtatatacatttgtcaatataaatcaaattgtacacttaaaatgactgcattttatgctatacaaatcatagctcagtaaagtttattttaaacagaaaagaaatatatgcattgtagaaaacttaaaaatatatttaaaatgatgtttatataattgtattagaaggaaatcactgttaaattttgacacaatcatgttctatcctaactttctcacttgtcacatcaatttcccaaatcaacaagacactttaataggactataactttctaatctgtatgacagttgatatagtttgggtgtcttctctaaatctcatgttgagatgtaatcctcagtattggtgttggggcctggtgagaggtgtgtggatcatgggagcacatccctcatgaatggcctaccaacatttccttggtgatgagtgagtttacacaagatctagttgtttaaaagtatgtggtacatccccccttctctcttgctcctgctctggccttgtgacatccctcctcccgcttcacctttcaccatgagtgaaagctcccttgaggccgactctgaagctgagcagttgctattaatagcaccatgcttgtacaacctgcagaaccctgagtcaattaaacctgttttccttataaattacccagtttcagatattcctttatagcaatgtgagaaaaacctaacaccacagtctcatattacaattatataatttctttaaattttaaatataggtttggtaagctattgattattgccacaatttcagagcctgttattggtctattcagagagtcaacttcttgctggtttagtcttgggagggtgtatccatgaccagatggattcacagtcgaattctaccagaggtacaagaaggaactggtaccattccttctgaaactattccaatcaatagaaaaagagggaatcctccctaactcattttatgaggccagcatcatcctgataccaaagccgggcagagacacaacaaaaaaagagaatttagaccaatatccttgatgaatattgatgcaaaaatcctcaataaaatactggcaaactgaatccagcagcacatcaaaaagcttatccaccatgatcaagtaggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccaatatcatactgaatgggccaaaactggaagcattccctttgaaaactggcacaagacagggatgccctctctcaccactcttattcaacatagtgttggaagttgtggccagggcaattaggcaggagaaggaaataaagggtattcaattaggaaaataggaagtcaaattgtccctgtttgcagatgacatgactgtatatctagaaaaccacatcgtctcagcccaaaatctccgtaagctgataagcaacttcagcaaagtctcaggatacaaaatcaatgtataaaaatcgcaagcattcttatacaccaataacagataaacagagagccaaatcatgagtgaactcccattcacaattgcttcaaaggcaataaaatacctaggaatctaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatgtatagattcaatgccatccccatcaagctaccaatgactttcttcacagaattggaaaaaactactttaaagttcatatggaaccaaaaaagagcccgcatcgccaagttaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctcatcttggacaaacctgagaaaaacaagcaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacagtgaactcaaacaaatttacaagaaaaaaacaaacaaccccatcaaaaagtgagcgaaggacatgaacagacacttctcaaaagaagacatttatgcagccaaaaaacacatgaaaaaatgctcaccatcactagccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaacccttgtggaagtcagtgtggcaattcctcaggaatctagaactagaaataccatttaacccagccatcccattactgggtatatacccaaaggactataaaacatgctgctataaagacacatgcagacgtatgtttattgtggcactattcacaatagcaaagacttggaaccaacccaaatgtccaacaatgatagactggattaagaaaaggtggaacatatacaccatggaatactatgcagccataaaaaatgatgagttcatgtcctttgtagggacatggatgaaattggaaatcatcattctcagtaaactgttgcaagaacaaaaaaccaaacaccgcatattctcactcataggtgggaattgaacaatgagaacacatggacacaggaaggggaacatcacactctggggactgttgtggggtgtggggagggcggagcgatagctttaggagatatacctaatgctaaatgacgagttaatgggtgcagcacaccagcatggcacatggatacatatgtaactaacctgcacattgtgcacatgtaccctaaaacttaaagtataataataataaaataaaaaaataaaattttaaatataggtttttaatagtttttgctttaaattattcaattcaattttacttattctgatacacggtttcagaataaaaataattattaatagtgttttgcagttatgatatttttaattttataattatttaaaagtaccttttcttatctatttacacatattcttgattgtttagatattataatgtagtcaaggactcggtacatctaggctgatagcaaaacattcactcttgttctgatttgcctattatatatttcagtgatgattcatgaaggttttcttgtttttactttttaaaataatttcacgtaattttaggtgacagaataatttttatgtttcgaaattaataaaggtgaattaatgtcatgtggagatacattatatatatatattcaagtgaattcgtccagaaagatggaattttaaatttccatttcttaagtctctcagtaatttctaaaatttcttaagatattatctatgttatttgtattaattttttattttattttacaatttcattgtttcttcaaatatatatttctattatattttctaacctgtaatatctcatttataaggaaattattgattttgtatatttagtttataatcatccagtttacttctattacttgcagtattttgtagttgcctcttttgcattttctatttttctaatcatagcaccttaaaataacgattattttgtcatcaattttcaaataggtaaattactgattcttttcttattgtctgagcaatacactcagactagtattaaataatcctgatgacagtgcatattatttcttgtcttttattccaatgaaaataatgttggctcttaggttatggtaaacttgcactgtggctaagagtatgtcctatggagaaattctgcatttcctagttgaactttcagtgactcaaactcctgagcctttttcttcatttgaaataaagaagctgatagtgccttatcttatagagttattgtaaggattaaatgaggtaacaaatgtaaaatgtttactacggtggccaacatattctaagggctcaatgttagtaacatcaggtatgaatgctaaattaaatgtctttctgtggacatttcttctgtggagctatttttttctcattctatttatgttatagataaaatatgatttagtatagtaacatattcataaaagaaaatataaagctattttttcattgatgaaacaataatttcctcaccacagaatagcatcattttatacacaaatgagtttgatttgctagggggggtttgttgaaaatatattttaaattagcatgtgcatgatcaggctgtacaactttgtgttattatctataaggtcatggtattagttttaaactagcttagcaaaatataaatcttagttatttttataagtgacagaagagtttatacagcatattaattatccgatcttgaaattttaaataaattctctgtaaaaccaaatgaaactagtgctatatttttagtaatgctttattaccttttttaatattttccattgtcattgtttctttcaagacttttgctttaagataattttattttgcatagaaacttatactttaaattagaaattatacttattagcatattttattgacagtattatcttataattttaaaatatctttattgtgattttattttcttaatgattaaaatttgatttatgttcgagttctcttcttgattacaatttcaaaatacttttcttatcattcattttttcttatacattttataaacagtacattatattgtgcatagtgttttgtatactgcttttgatcaattaagttctttaaacaccattaattttacttgtatatcataattttcctatatgtggtgtttttttggggtaatagcctcattggtatataattcacataccatacaattcacttatttaaggagtacaattcaatggcttttaggatgtatacgaaggtaagaaaccattaatacaaccaatttcaggagattttcattactcttaaataaacatccacactcattatttcaatgcttgcataccattgaattatgcaggcacagtgtggttactaaaatattctcaattattgaacaattagattatttatacattatgatattgttcccaatacatagacatgataaatattggatgtgatgtgaaccccaaatacattgacttgatcattacacattctatgttggtaaaaaatatcacatgcatcctataaatatgtataaatatttctcaacaattttttgaattaaatattctgatgaacattcctgcagccaaactttgtgtaagaacgctatgagcatacgtgcaaaaactaccagatatataccaaaagccttaaacatctggtaacttttcatggagaaataccttccttctagatcattcaaccatggctattagcattttttaaatggtaaacattagaaaagtcatgttatatttgtatattattttgccttccttcaggtgataccaagtggaatattttttatattttgattagctgttgtggtttattttctgcctcagaagtatattaaaagttttttgtttttgtccttttcagtttttgaaaataaccatgtcttttgtaactgttttgtatcttatttcagttgctgctctgtcttctttttttaattaaggcaatattagccttatttttccgtgtttttaatgacaatgcagttgtgtttttacttttttagaaatgatattcctagtttcttaggaacttgtttttcatcaacagtggtaattcatcaaattggtaatgaaatttatcaactgaatttttagtatctttccagattaccattgattttacttgatgatatatgttattacatttattgatgttaagccactttgcatgttaagcgtaaaacctttttctaaccaacttatatttggatgacataccattgtgttttattttctagaattctcatatctatattcaaatctcattgcagtttttgtgttatatttctgttttttaatatacaggtatttcttgcttggcaaagtgattagcatgttttgatattttttctattgtaggagagtttggtttagaattcataatttcttgaaagtatggagatatttcagtgtaaagttgtctggcttttcagattattttgagctaagtatttgacataattgttttttaattttttttttttttttttgagacgaagtctcactctgtcaccaggctggagtgcagtggcgcaatctcgactcactgtaacctccgcgtccagggttcaagtgattctcctgcctcagcctcccgagtagctgggaccacaggtgcatgccatcacgcccagctaatttttgtatttttagtagagacaggatttcaccctgttggccaggatggtctcgatctcttgatcttgtgatccgactgcctcaacctcccaaaatgctgagattacaggtgtgagccaccgcgcccggtcctatctgagataattttgattttaattttaattcttttgaacttctattttagataggagggtatatgtacacgctcattacatggttgcattgcacccagatagtgagcatggtatccaacaggtagtttttcgacccatgacgtcttcctcttccctctaaaagtccacagtgtctattgttcccatgtcataatttttatttttttcataagtataggttgattcacagtttagaagttttctattttttgttttgacatcctgtggtttcctagaaaataagtcatattttctagatttccaaattcattagcaaggagtaatacatattttctcatacaatcaatagttattaatacagcttcttgctattcctgatttatttgtattttattatacattatccattaagcatgacagaggttgctgtagtttgtcttttgaaccaatttatagctttaaaaataaattaaaatatattactattgtacaaattgttaattcatagtttcattatttttatttacttaaaagtacagattattttcattatttctcagtaaaaaatgtagtgatgctacatgatgaatttaattttggcagtttcggctgtagtccatgttttagtgaaaatctttgttttataatcctcttgatatatatttagaatcagtttggaatgaacatatgactgattgagaaatgaattctggaggaatgaaaccaaagaatacacgttattcagtatcatatatattttcatttgtggttaattggtacgattccaataacttcagagctagagaatgtaaaaataatattgcagtgttacacaatcaaattgagatggcatgaggattaaaatctttatgataaaaacacaaacacagaaacaactctggcttcatttttatgtcatgtgtcttaacctggggtttaataacctaaaaaataaatctggataccacatcaaagggctttcaacgagctctacaaaatgacatcctggccaaaattagaggttttggtttaaaaagggtggaaaataattgagggtgtggtgtgtgtgtgtgtgtgtgtgtgtgtgcaaatagataaatataagccctttcttttattttggtatcaatgctagtcctaggatactttctcagagacctatgacaaagtaactttggaagtttaatcatttcttacaaattattttttcagaaaattgacgtttgagttacaaaaaaacattaaacattgctctagtaacagcatgtatattgtcttcacaaaatatttaatgccaaaacgataatttatggagagaaaaattgtattttcttccaagcatgtgtagtgagtgtttcaaaggtaatcatgaagcataagataaactaagaaaaatgcatatactgataatgtatttatataggaaataaataatgataatacaaatttacaaagctgagaaaattaagggaatgaattgtgtctgtttttatttgaaaagactattatagttagttgagatgtaagggttgaaatatgattgctatgattcttatacttatcagaataattttacagatgacatagcatacaattactagtataattactactcactccaggaaataattgaagtcatttattaattttgagattttttttccttttttccaaaacattatcataagagtttttccatctttatatggacaagtgtattcagatttttctcgtttttcagataggaataatatgtgctaggcacacaactgataacaacaacaaaaaaataaaaacatgacaacaggactagagtatatctacccatgtgtacaaatgtgcctgtgatatgaagggtgaagtatttgccaaccaaatggtaacttgccttctaaactagattcctttcaaatccaatacttcccctttatactgacatgttggttacctacattcagaggaatattgtatatagtcatacaactagtattagtcagtcagcatgctaattataatacaatcatctatgtggtgaaaactgctgatgtaacatattcagctctgtccacgtggggctttcatgcttttgggtttgatgttccctacatctaaaatgtcctggaatcgacaaactagccttagaataatttctcatctttcaaatctgactttacgtgccgtttcacctgtgaagaatttaaattttttggccaatcttaatttgccaaagaaaattgactatgctctctccttagtcttcaactgtgccctggcatggctaaaacttaattgaacgtacttatttttgtaatgataaatcctttgaagtcaaatgccatgttcacttgtttcgattcaacattcccaacacattatctcaaatattatttattgattgaataaacgattaaatgaataaatgtattaatgaatgaatagaaatcaacaagtcaattaagttaataagctggtcagatttgtcacttacacctcaaccacctcaaagaaattggctattaccttcaaaagatgaaatatgagcttctttggaagttacacgagaaaacagcatacttggttgttttcttaggaatgtgtcacaatcatttcattatgacaccaacaacatcaaattgggctctcaatttgcatttaagggattgacaaaactaggtgtattacaaagcttcgcatgttggctgagttgtaaggactcaaaaacaataaatgggttcctaacatgaatttaccgtaagacccagaaacttctcctctttggttaataaccaaacaaagcaaaatgaggtattcaaactaatccctctacatgaataattatagcagcactgttcacaatagccaaagggggaaaacaacgcaaatgtccatcatcaactgataaatgaaaaaacaaataatgaatttcatacaatatcatgttgtatagcgatgaaaagaaatgaagtactgatacatgctacactatgaatcttcaaaatattgtgctaaaggaaaaaagccagacacaagaggtcccatattgtatgtttttatttatatgaaatttaaagaataggcaaatctgtagagacagacacagaaagcaggttgatggttgtcaggggctgaaagaaatggctgcttactgtgaacagagtctatttagggttgttaaacaattgttagaactagataaaagtggtggtcatacagaattgtgaatatactaaatgccactaaattgtatactttaatacagttaattttatgttatgcgaatttcaccttgattaaaaaaatacagatggccgggcgtggtggctcccgcctgtaatcccagcactttgggagcccgaggcaggtcgttcatgaggtcaggagtttgagaccagcctggccaatatggtgaaaccctgcctctactaaaaatacaaaaattagccaggcttcgtggcacacacctaaaatcccagctacttgggaggctgaggcagaagaatcgcttgaacccgggaggtggaggttgcagtgacctgagactgtgccactgtactccagcctggtccacagagtgagactccatctcaaaaaaacaaaaaacaggccaggcgcggtggctcacgcctgtaatcctagcactttgggaggtcgaagcaggtggatcacctgaggtcgagagtccagaccagcctggccaacatggtgaaaccccatttctactaaaaatataaaaattagctgggcgtggtggcgtgtgcctgtaatcccagctacctgggaggctgaggcaggagaattgctggaacccaggaggtggaggctgcagtgagctgagattgggccactgcactccagcctgggtgacagagtgagactacatctcaaaaaaaaaacaaaacaataacaacaacaacagcaacaaaaaaccatagatgtggctataggggaaaaatcaatgaatatgaggatacaatgaactcatatgggattaattgatgttatttctcttttctttattcactttactaaattcatgtttttgtctaatcttctaagaatcatgagaattgatctaagagtttactgattagaaaattttcccaaaaggaaaaaagatacttatgtctttgttttaggagtagcttctgcttagaaaataaatgtgaatttattacttaggtgtcagagtgtttattttaattaggaaagaacctgtctgtctctgaacactgtacagcttctttttaaaaagccaaaattaattacatatgccactgtcataatacgtaatataacctattgactctagaatttgagttgttagctctgtcttataaataaatataattttattgctcaatgctttttaaagtgtgaaaggggccattgatgtcatattgaaaatgcctataagatgcttttacatctgcaatctacaaagagacattgataatgggaccataaaagaatacttgtgaagctagtccttagtgccactgactttttgcagtagttgtgagcatggttctatgaaggatttgatatatgttgttgcttaagtagaagggtccatgtttcacttggaattaattcagccctttctcttacagaggagcctctgcttctgttctgctctaatgacagcattctcattagaaagcccagaggggttctttaaaaatgtaaatgagatcacattactgggactaccctcaaaaccctccagacttcccatttattggacagaaaagtttaaaattcttacagtggcttgcaaagccttttgcctctgacctcatcttctattgctctgtgttccagagattttggcctctatgctattgattgtgtatactaaacatgctcccatctcaaggttgtcacatttgctgtttctactgcgcagaatgttcttctagatatatttgcataactcagtctcttaatttcttcaagtctctgatggcatgtcaccttattatgggcgttttccctaactattttatttaaaaacagcaaattctccagcacttcctatttgttattgttttattttctccataatagtcatagccatctgacatattacgtattacaaattttttacatttattgtctgattccctcatctagaatatcagctacataaagccagaaatatttttgtctgttttgttcactgctgtattacaagcacccagaaataggcctgcccttagtaggcacttagtaaatactggttgagttaatgacctgctcggtaagtggtgattcattcaatctaaagagtctgatgattcattcctgcctgtctttagttatgagtaatatttttgcccctggtaacttcctctctgtaatttctttttgaaattcctattagtcacatttatccaatatgttgtcacttttttttttgtcttttgactctatttttttaagagacagcatcttactctatcacccaggctgaaatgcagtggtgcattcacagctcaccatggcctggaactctcacgctcaactgttcctcctgcctcagcctcctgagtaactaggactacctgtgtgtgccaccacccctggcaattttttttaaatttttgtagagacaggatcttgcgatgttgtccagaatggtcttgaactcctagcctcaagcggtcctctcaccttggcctcccaaagcactgggattacatgttgaaccaccacacctggccttttaactctattttcaagagatattcttgattatatattttattctttctaatgacttccaacttttaattggtgatgtttaatttctatacattctcatttgttctattacatttgcttttatataaaatcctgtccctttttattgatgaaattggtatcatcccaaatatacttgagtagcctaattatattttgctttcatacttcttccttgaattgtatgtatttctcctagtgtaaaatattcaatttaatccttatgctctttctattttgtacaatttttttcaaatatgggtttatctttgatggttagtcattttgtaaaaatcaaggcctaggctgactatttgtagagcagattgtttccctaataggtgccttccttatctgaaagggaagagttctgtgtaattgagtaagtattgtagcctactcaacttttcttaattgtgcattggaggattggtgaataaccaactcactctgtttcttatcacttcataattaattgaaacagaatcgtgtgtgctgaaaaccttccaatgagcctaactttcccaggctgaacatattattattattgttattattattttgagacagagtctagcactgttgcccagggctggagtgcaatggcgtgatctcagctcactgcaacctctgcctcccgggttcaagcgattctcctgcctcagcctcctgagaagctgggactacaggtgcgtgccaccacgcccagctaatttttgtatttttagtagagacatagtttcactatgttagccaggctggccttgaactcctgacctcgtgattcgcccgcctcagcctcccaaactgctgggattacaggtgtgagccactgggcccggtcatgaacacattatttctttagagaacagtcttttggtagtaagcactgggatgcttctgtataaaccggaatggcaagtggccagtgtggtcagatgcagccattccttttatgttcctttaaatattcaccttctgtgttggtacttccacctgcacatcttccagttctgactgtctggtattccagagctgtgttaggaggattggcttccacctcaactgtcagtagcactttcagactggcttctttcacttaacaatatgcatttaagattgttccatattttttcatggcttgatagcacatccctttttatcactaaagtattctaccgtatgaatgcaccacagtttgtttattcacctattgaaggacatgttggttgtttccaagttttacaaatataaataaagctgttgtaaaaattcctgtgcagttatttcccagctttattgagatattaattgacaaataaaaattgtacgtattcaagttgtatgtgatgatttgatatacatatgcattgtgtcatgatcactacaatcaaattaatcaacacttccataaccacacataggtatgctgtccgtgtgtgtgtgtgtgcgtgtgtgtgtgtataaggaggtgaggaaacctaagatctactctctcttagcaaatttcaagtatacgatatgatattatcaactctagtcaccatgctataaattacatcctcagaacttcttcatcttatacctgaaattgtgtacccttttaccattatctccacatttcccttaggctttcaggtttttgtgtggacaaacgttttccactcatttgtgtaaatatcaagaagtgtgaattattgaattgtatggtagcgctatgtttagttttgtaagtaactgacaaaatgtcttccaaagtggctatgccatcttggattcccaccaacgatgattgagagctcctgttgctctaaatccttgtgttttaatacaattttgtaaaagtattatagtccaagaatacgaaatgtgcccaatatagaaaattcaaatttatccctaatcctattaaaaaaactattttctgctactatgtgtgtatttatatatacacagtcatacagtgtatatatgtttgctttctgcctttttcatttaaagacacatcatcaaagaataccatgtttttgcacactcttcagaagagcacttttttttgggggggtgggcaggcagggagatggagcctggctctgttccccgggctggagtgcagtggcgtgatatcgactcactgaaacctctgcctttcaggttcaagcaattctcctgcttcagcctcctgagtagctgggactacaggcgcacgcttccatgcccagctaactttttgtattttagtatagacagggtttcgcggtgttgtccggctggtctcaaacccctgagctcaggcaacccgcccaccttggcctcccaaagtgctaggattacaggtgtgagccaccacgcctggctggggtagaagagcacttataatggtagattaattctgcattatttggatttgctacaattgaatagctatttctccattgtttggaattaatgtggtttttaattacctcatcataaataacaatgagatcaatgtacttgggcctgttagagtcctccatctaaaaattggttggatttcagaatatgctcaagtgcttagcacttttaagttttgaaagcaggaaataaatgttaaattaacatttaggaagttagaaaaggcccaaaatgaggatcacggaaaacccatatatgatacctactttgacccggtattctaagcacgtaattggtattaactcaagtaatgctcacaagaatctgaggagactttgaagcattattagcccaattttacagctaatgaagttgagtttaagtaacttgcttaaggcattgtacctagcaagcatgggattgatgattcaaatctatacagcctggctctaagcaatggtcttcacagtttcactccattgttgagagaacatttgacttgcatgatttaaggtagaataaaaatcttgatagggccatatagatctcattatgtcctctagtcttacatatggtctattgtctctttagattacctgtcctacatgtagaggcatttgagtttgcagccccatggcaaagtaatgaaaaacctattggttatgaggtcactagtgcagcctaacaaagacatggcccagctgcttatgttgcaagtgttggaaaactgatcaattttctaacatcacttccctaaaaatacattttggtgtgtggatgaataatgctgaataaataccagatagctatgtatactcacagttctgaaaatacatgatccccaacacaattttagttgtgccttggtgcagacgaattttttcacttttatttctctgagaaactattttaaacccacaccaacctcattaatttccacatcaaacaatagggctttgactatcagcagatgtttatactatctgttagccataaaaatttaggacactactcaaattgtaggtaacaaactaatggctctttttgcttgtcattatccaacatttttgttgaaagacccaaagtcaaagaggatggtccatgaactaaatgaattacaaatccatctaaggccaaaacagaagaatgtaattttaaagatactgagcctatgcttttacaacctgaactccctacaaaaatgtgaattcttatgaaagacaaataaaaatttattttcatagcatagattaggaaaattatgcacattttatagattatagacaaattaatatccactttataataggttatggcttactaaataagtaatgtttaatttaaaaattcaaattgtaaatactcaataatatttaaaatatttgtatactttttttttttgagacggagtctcgctctgttgcccaggctggggtgcagtggtgcaatctcagctcactgaaagctctgcctcccaggttcacgccattctcctgcctcagcctcttgagtagctgggactacaggcgcccgcctccacgcctggctaattttttgtatttttagtagagacggggtttcaccgtgttagccaggatggtctcgatctcctgaccttgtgatccgcccgcctcggcctcccaaagtgagccaccgcgcctggcccaaaatattcgtatacttaaaatagtagtcgaggctaggcgcggtgtctcacgcctgtaatctcagcactttgggaggccaaggtgggctgatcacaaagtcaggagattgagaccatcctggccaacacggtgaaaccccatctctactaaaaaaaaaaaaaaaaaaaaaaattagcatgttttatgactttgtttatgttctggttgcatatgtacattcactttaagaaagttattctagctttacacttatgagtcttgtacttttctgagtagatactgtatgtagttcaataaaaatatacttcaaacaatatatttctaagggaaaagagttctgaaatataacataaccattttgacatactaaaatatatactccatgaagcattacgttaactgcaatatagacacacacacacacatatatatgtatacacatatatatgtatttccatgtgtagatataaattgacataatctatgattgagtcatacgtactcagacaggcatggtggtgcgtgcctgtaatcccagctacttgggaggctgaggcaggagaattgcttgaacctgggaggcagaggttgcagtgagccaagattgcgccactgcactctagcctggcgacagagctagactccgtctcaaacagaataaaaataaaaatgaatagtcactgtttaacctttcttgtccagtttttgtgtttttaaaacatcctgcagaaatgtgtatctttccttggggttgcgggggtatacctgtgatatgtggctttttaaaaaagcttttgctgcttttttttttcccctttttttggagagagagtctcactcggttgcccagactggagtgcactggagcaatcattgctcactgcaaccacaaacttgcctcggcctcttaaagcactgagattacacgagtgagccactgtggaaggacaagctgcttttatttatgcatattaatttctttatcacacattttatttttaaaattatttctagtgtcttgagtttaatgttcattttttatttttcatccattattttttcaaatatgaaagaactcaacactatgaattgtccatggagtataaatttggttgccttttatagatttttataggtaatattctaattatttcattttattaatattttctaatggaagttccacattttccaattttgcttgagggttgcttataaaagttttgtttttatggttgtttattttcacatctgagaatgttttgtttttagttttgtgcataatttataattgggtaaactcttctgcaacatcatctctacctcctaccttgcatgctattctatagccaatcattttcttttatatttaccaaatatctcttaaatgcaggccataagtctgacacctcactaggatgtaataatatacatgaagcatacagtgtatctggattcaatgatcttacaatgttggtctagtggcatacagtaaacaaataagagcaggcatggtaaacatattgagatcatatatatataaaagttgagtggggtcacaattgagagaccgtgagatttcagagaaactcttcatagagatgaaagatgagaagagttttgaggggagaggtatttacctagtagaaaatatttggatggaaactttctgaatagagaacaacattctgtattctaaaatctaataactttgtagagggctccttcttcttctgtatgatctcctattctgtgctctttatcctgtcttacttccatctcacacagatacaatttttcattcactttctcttcttattttaaactttttccttctcactcaactctttccttccaaatttatgaatatatccagacggcactcattctaacacacatgtacacacacattcctcctcttaactcttcatcctgttcagctcttgctcttgcccataatcagaactttctgtcatgattttctcattgttcttgcttttctcaactcatcataatgtgactcttatcccaggaatggcaggaagttatttcgctgagatcaccactgacgatctaattgcaaaatctaatgggcatctttcattactcttacttttggaggcacacgatcatattatgcacatatatattgccgacacaatcccgatattatctggattaagattgtttgcatgtatgtcccttaatagactagaaaaatgtgagggtaagagatattatgtattatctatctttgatctatctttgtagccctaatgtttagatcagtgcttagtacataatagacactaaaaaatttagtgaactcagtggtgccagcaattattcagatattgagttctcctggggagattctttgtgatgtgctgatgcatttaggtcaactctgtccaattatcattttcatgtcctagagtcattctaaacactctagctcctgagcgtatgtattactttaatgatatctttaccaatgctttggtgtgttagtctattcaggcttctattacaaactaccattgacaagctgttttacaaacaggaggaatttgtttctcacagctttagaaaaccagaaagttcaagatcaaggtgccagcagagttagtgcctggtgctggccacttcctgcttcatagacagcattttttgttgtgtatccacatgacagaaagggcaggtaaatatctctggagcttcttttttaagggcactgatcccattcatgaagactctactcttgatgtaattatctccaaaaggccccacaaccaaataccctgacattggggattaaatttcaacatacagttttttggtggaatgcaaacattcagaccatagcaactgacataaatatgttgaatcattccctcattcaaaaggggttttccatctaatggatgtagatgttatgagtagagaatcagagaccccactgctgtggaagcagaccctccaaattagggcaatttttctactggaaggttttgaaagcttcaacaggccacaatagtttcatttgagacaaactctaattccatgtaatatatgtgtaatgtgtgatgtgcaaagtgtgtttgtgtgtgtgtgtctgcgtatgcatagacacatccgtgcatgtctgtttatctcatagggatcttggttttacacccaagaaaaaagtatggcttctcttaattctgcttcttcttaccagcccttagaattcaacctgcttcctgtcacagaaaggtatatgactatcttaaaatatgattttattagccccctttttctctattatgatcttggaaacttgtcattattattcagattagctttactactgtattaatgagataattaatgtatgtaaggatgtatgtgtgagtgtcagtgtgtgggtatttgcatgcataattttgtttttttcttgaatttcactgaacagatttgtcatttacatcatttggatacataatacattccatttgtgtaagtgttttttttttttttttcatcttttgaaaattaacaatggctatctggagccaaagattttaccagatagaaataaggtttctctttattatagaattgacattttcaatttttattataaaaagcaaattgaagtctttaattgcctgggttttatgaatgtattgaattttctaatttcaatgttaatggatacatatttctttctagatttcttttcttttaaataataagcaactggtttgacatgcctttaatcaagatttatcatgaccttattagaaagttaatgtttggaacatttactctctgatgaaccaccaattttgtattttacatttatctgcaatttccaacagtgaagaggttgtctgcaaatggaattaattcttctccatttggttatcatctcctttgctccaatccctggtaatagctaagcttgttcaagatattaaagaggtagatcaaggatctaaatggtagggaaaattttcaatttcttaaatttcatttattatgttgataaatctggcctctttgatagtttgtcattttcatagaattgattattcattagcaccattgcagaccatatagctaccatctttgcttaggttttctagcctctggatctgattgagaaaggaagacatttgaaagcatatctgagtacacatgactcaatcattgattatgtcaatttatatctacacatggaaatacatatatatgtgtatatatatgtgtgtgtgtgtgtctatattgcagttaatgtaatgcttcatggagtatatactttagtatgtcaaaatggttatatttcagaactcctttcccttagaaatatattgtttgaagtacattgttattgaactacagtatctattcagaaaagtacaagactcataagtgtaaagctagaataactttcttaaagtgaatgtacatatgtaaacagaacataaacaaagtcataaaacaaaattactagtgcctagaatcacccttatatttcctaccaggcactcacttcttacaattacaacttttgacaccatgtattatgactgaacttttgtgtacttccaaacttcacatgtggaaatcctaatacccaatgtgatggtattaggaggtagggccttagttttaggtaatgaatgtggatcccccacgaatgatgctgtgcctgaatgttggtgtcctcccccaatttgtatgttggaacataatatgcaatgtggtaataggtaagggaaagtaattaagggaaagtaattaagtcatggggactctacccccataaatgggattagtgctcttataaaaaagtttaaaggagcattctggtttcttccatgccttccagcatgtgaggacacagcattcatcccttctaccatgtgaggatatagcaagggtgtgccatctatgaggaatgggccttcgccagacacaaaacttgtcagtgccttcatcttggactttgcagactccaaaactgtgtgatataaacttctgttatttatacattattcattctaagatattttgttataacagctcaaacggactaagacaaatgaaaattgcccttataagaagataaaccacggcttcttttcttggtgtttggttttcaacatgtgaggacacagtaaaaagacatccttctgcatactaggaagaaggccataaccaaaatccagcaatactggcaatcttatctcagacttcccaacctccagaaccatgagaaatacatttttgttgtttaaactatccagtctatggtatttttgctatagcaggtcactgggaggattccccttcaatggaattgaatgcaattcagcttaatcagtgttcaagatatagcgctgtttctctgattaccaggattcaggggttcagacggaaattggagtggtggtaacattcattattacctctactgacctacaggcaaaaattttgtttcctgttcctgtgactttatgctctgctagcctaaaggtcttaattccagagggagggatgtttccagaaaaagacacaacaatgattgtatcaaactggaagttaagactgacacccagcaattttgggctcctcctgcctcagtcaataggctaagaagggaattactttgttggctgggacgaatgatcccaactaccaagaagaatatggactgtgactctacaatggtggggaggaaaaatatgtatagaataatagaaatcttgtacggattctcttattatgactgtgcactgtaattaagatcagtgaaaatcgaaaacagcccaatttaggcaggactatgattggcctaggcccttctggaattaaggtttggttaccctgccaggtaaaaaatgacaaccagctaagatgcttgctgaaggcaaatggaatacagaatgagttgtagaggaaggtagtttgaaataccagccttgatgatgtgaccggtttccaaaaggaggactgtcatcatcatgagtattcccttcttattttgttatgaatacagttgtgtttatacacaaatacgtgtgtgtgtgtgtgtgtatatatatatatatgtatatatgtaaagcaaatgcctttgatttattttctctgttattctataataatttaaaataaaacatattgactttatattagtatttaaatattgtcaatgttacatcatagtatttaagttacgggatgtcaggagaggagtaaacatcactcatttactttactttctcttgtgtggagatcaatggattttttgttgtatgcagaatagctgcatcatgtcaggaggaattatgaccattttcctgtcttaatttggagattaagtatggcttgaggagatgtgtacatgtgcccagttgacaaggggtcttcttgttatggttcatttaatgtgttgacctggactgtgctaagggatgctcagataactagtgaatcattattgtgggtgtttccatgaggatgtttctgaaataaattagtatatgtattggtgaactgagtaaatgtaaatgcccctgctcaatgtaaatgggcatcatctaatctgttgagggcctgaataaaataaaaaggcagagaaagggtgaattcactctctatgcttcagctgggacattcgtcttctgctgcctgtgaacataagtgctctggttcttaggcctttgcatttggaccgggacttacacagtggttcctctggtcactgggccttcatacttggactttgtcatttaacatcaactcccctgatgctcaggcctttggacttggactgaaactataccactctctttctggtcccccagcttgcagatagcagaacataggacttctcaacctctgtgattgtgtaagccaattccttataacaaatcttatatagctagacatagatagatgatagatagatagatagatagatagatagatagatagatagatagatacatagatgatagatagtaagtagatagtagatagatcgatcttctcttgcccctttttctctggagaatcctaagacaactggttgaacatcttttcatgtgcttgtttaccatctgtagatcatttttcagtgaaatgtctgttcataccttttgaccattttccagttaggttattattaattttttacagttgacttttaagactactctacatgttctggatataaatcctttgttagatacatggtatacaaatattttctccctgtctgtaccttggttttcttcctcttaaaagaatctttagactttgatgaaatctaatttataggtgtgaccattcgtgcagtaccccagtatgttgttatgctatgactaacctgcagtaaaatccatctacccaatttataatttcatttattttgttttttcaaaatttctagttaaaacaataaattctaatattctaatgaaatcattcacttttttctcttatctgccattatttgccttccaactataatatctggaatacctcagctctgttattattttatttgttaatcttccttttggttataggattctgtcttttggtaggaggaagtttttgacgaaggcaaggtattagttataaacgaagttacacactccatgtggtaatattttcctgcacacatagtttcgaatttcctctgctaagcagagagaatgaggactgttcactttaatcttaacagagagactgatttcaataggagcttcattgcactttttgtaaagcttggtagacttctgctttgacactgatcccagggtacatactttcaactacagtgtgactgagtctagaccttacaactgagagcctggtatcataactgagttcccttcactggctggtcctcagctttccttttcatctcctgagcaaaaataaattgcagaaaactttacaccactttacagagaatatcagcttagcttttcagcaccttgctacttgtagcttcagaatttggcaaactttttgaaaataaaacaatacacattcaatgcccagttttctgctatttaatatgttgaacattttgtgccataaagctttcaattttctctctagtttgttgacactgacaaacactttgcttatacctctgtctttcagcaaccattctgcctgagcaaagactggattttgagctctcagtccatttatgacaaaatggactcctgaggtaaaagtatctactcaactctcagtgtttcttctctctcccagaatcttgagcactctggtcttgtttctgtattagttccctaatgcttttaagaaaaagttatttatattttatgtaacttttctactgtctttttctctgtgaagcattggttggctttgagatactttatttttttgtctttttgaagtacttttaaaacactgaagcacgaaaacagaggcacaatcagttttgttcatagttgcatcttgcacaaggatactcgtattacataataaatttggaagataaatttgctgttttcaaataagtaacagactgcttttgtggaataaaaaagtggaaaatttgttttttttgtgtgtattcacagagtcgtttctatattttatctaaatttgtatattctaagtagaattgaatggacaaatcatttgttttgtccattattcatataatggacaaataattaatcattgtgtcaaatcatttgaagtcagtaacaaatttcctgattaaattttgtttgctgctctacacttgaatttttaataactttccagctattaaattgctatgttataacatcattttgaatattattgataaggatcttgttacaaactgcagaaatgttactaggtaaaatgagtgtttggcctagccaccacatatgcaatttagaacaatgtgatttccattcgttcatagaggtgcgatccccacctctagccaaagatccacagccacgcagggtgcatggtggctccccttctcaccccccttccctcctggatggggtgcttgggcggatccacggcacacacctgtgtctgcacatgtggggcgaggggtatgtttgcaatggccatgcagggtgggagagaactgtggctgctgcccaggccccagggcagtctcaggggccaggggcctcacgtggctagttggccagcatgtcccacccgccatcccctcctgccatgtgcccatagagtctttcctccccgggcgagaggtccggctttgtccgagccagaggaaggatacagtgatttaaggaatccatttgcatagaggaagaggttcttctccacctaaatcgattttttttctttttccttttctatgtgagaggtttcttttcctacctctgcactctgcttatgataggaaagcaacagaggagccatcccactggctaataacggcaaatttggcaaagtctgtctgggacttaatctaaataaatccatgcatcccccgagacacctttttgtcccaaactcaattacaaactttggttgaagccctagaaaggaaaaccagatctgagggatccaaagccaggcaacaggcacagagtaaatgggcaggactaattcctgttgattaagcccctgcttcatggaaggaggccatgttccatgtcatatatagataaggcctagggaactcaagagatttcatgactatgaattacagtaaaaaataagtactcttgcaaaacacagttggattgtttgtaacacaaagaataaatgcttgagaagatggaaaccctattctacatgacgtgattatttcacattgcatgcctgtcaaagcatcccatgtaccctataaatatatacacttactatgcacccacaaaaattaaaaataaaaagtaaaaatttagaaacaaacaaacatacaaaaaccaaaacacatcatacttcagttttgaaacattaaggtcccaattatgtttactcaaaaataggtttttaatttggtagtttttttatttttgagtgtgaatataaggccaagcttgcttctattcttataatttgagaatttaacaagcattgtttatttgtggacgtcaaactcttttttatttgacatatacaatataatatatataattataatattatatattataaaatctctactaaatagatatatttagtagagatggggtttcatcatgttggccaggctggtctcgaactcctgacctcaggtgatccgcccacctcagcctcccaaattgctaggattacaggcatgagctactgcgcccagcccctcactatctttatgagcagacacaacaaagatttattgagtaaatactatgttcagggcactattccatgtactaaaggatttttaaagataaataagacatggctcttatctctgaggtgttcacattctcatgtgaataggacaggcttatatacaatagtctaacacgaggcattatgtgaaaagtatatttcttcgcctcttctcactgcttagaaaagtgtctagaacatagcgtgcactcaattaatactttctattagcattaatattaatcttgtcatcattggaaaagatataataggaactgacactggagaaataagtcaggtccaaattatagaaagattactatggtagtcaaaatcccccacttctcatctccactgacactccaaccttgatctagatgtggttatacctccataatctctcactttgccgcacagtctccccattggtgtccttgactcttaatgtgcactcctccatgttcaaaaaacagaaccattcttaaaatataagtcaagtcatatgatacttgtgctcagaatcatcaatggattccaaattagataaaagtataagcaaaaaagccctattttgtcctaaaatgccctacagatctgtgttcccactatttctctgacttcgtcttttactcctctcttctttatttttctcaagttacaatgccccattggtattccacaaaaacggcaaacatacttctatctcaagtcctttgcccttgctattccatctctctggaaaaactctttacccaaatatcagcatgaccaactccttcatttagtccaagtctctgtgcaaatacctctgtatcagagagtctttaccttatcatcctatgtaaaacagcactccaaatgaccctctttaaattttcagtatgccactcatcaccacctcaaatattgtattcactgtgtgttttactttaactcttccccaaccctagattataaactctgtgactgaaaccgtaactattgtttgctactatattatcagcagtagaacagtgcttgactcatagtgaggtcttgatgaatttggttgaatgaatcacttaatcaattgtcccaactttataaactcaagtttaaggtatctgaaaattctagtctaatcccaaaccatattgatgtattggtccttatttaaacccttaaaaaataggcattaattgctttatcatgcagtctcttttaattagtgtaattttgactagattgatatgctggtttagtaattactttgtgattttatatgtatatgttacatgcttggattataatagaaatgctagattttaaagttactgaaacctataagaaagcagttttgtcttatttttttaaatataactcagccatcttttctgtacacacacatacacacacaacctcatagatgtggttttaccaatatcaatttaaagaagggcactatgatgtttgttttagatctgtacttcctaaattatctgtagtctaagaacagtttttctctccatctaccatggattcacacttttataaaataaaataattcattaatataaacttaatagagaaaagcaaagacatgagtcaagtctatgttttaaatgattagattcaagagacataaagttttctgtaaacatttcttttttaacattctgtttcaatttatgtacttatcacaaaccagaatcaaacaattcctggattagcactggtatccagacctaaatttgagtagcattgctttatatattaaatttcgaacacctctctacaaagtatttatattccagcttttttaaaagtaaaaactgactataagagaagttaacgtaatacagtaaagactatttaacaggaacatttgatgaagtagatcattcccgtcttctaaaaactttcactttctttgtttttcattacaccttgttcttctgatttgtgtttttcccctctgatttgtttcttttctgtttccttcacttcttcttacttatccaaagattacagtatctttgaaatatgttttgaactctcgtcttttctacatcaaaatacacttcctggctccaattgtgaactataaaacattgattaaaaatgtatatctaacttctgatctctctgcacattgtcacatttgactactgtattaatcatttttttaaatgttatgtattttatgatgtgttgacatcttacaaaggctactagccatgtaaagactgccagggccagggctagccaattctttgagttagtaaagggccaggttgggagcatgtcttgcatgtgcaatcgagccaatctttggtctatagaccaaagtctatagctccattcacagccttgtctaactctttacacaccaagccaagatttaccttgccctaaatcacctagggccaaatataaaaaaaaactggagaccgtctttatacctcaaggccctttcaaattattcaaaccagccaatattaagttgtttattctgtccggccttgcttttcccatagaaacccccataaagactctggctctggattccctttgcttctatctttttccatgtgagaaaagcctagccctctgtggtcctctgtgacatttggcgaccctactctgttggacctgtaaatataatcaaacctcttccttctaggccttgttcttgttttcctttgcagctacactgactgtaccacaccacatttttcgaacttttatgcgtgcccatatgcctcacaaacatatataattcaacatacccactattgaaatgaacattgtctcttcaaacgttttccttctgttaatatttcctacatcagcaaatggaaacatactctttcaataaacacaattgggaaactttaaagtcatccttgactagcctagtttatccatttatcttttattattcaatcaattggtaacaaagttctgcctccaaaatgtatctcaaatatcatttacttctctatcatttttacaaatatcagtatagtccaggacacaatcatctccatcatgaagtcctgactggcttcccagtttctgctcttactcatcattctgatctatcttccactaactgccacgtaatctactttttaaaatagggtaagattgtatcttgttttcctgagacaattgtaattttcatctattatctcatatagtgattaatggtaccccttcctttctattaagtgagacagtatgtacaatatattctatcttcacgctacctaatagtcattaaaataatttattgagccatgacaaagtaattggctccagaatagtttcattctcttaaaaaactagaaaagcatattaaataagttcgggctgtggaaagcagatagtaaaggatagcaatcactaagaaaagtgaaaacactgaagtaagtcctatgatcacccaggatttctccctgcgggtaactgtaggctatggtgcaaggacaggaaatccctacatatcgtagtagttctattaaattgaggatactgagttaagaaagccttaccaactggaatttgtcagatagagtaatagagaagggagggtgagagtaaaaaatagattcaggtccgggtgcggtggctcacgcctataatcccagcactttgggaggccaaagtgggcagattacccgagattgggaatttgagaccagcctgaccaacatggagaaaccctgtctctactaaaaatacaaaattagccgggcgtggtggtgcatgcctgtaatcccagctactcgggaggctgaggcaggagaatcgcttgaacccgggaggcggaggttgcggtgcgccgagatcacaccactgcactccagcctgggcagcaagagtgaaactctgtctcaaaaaaaaaaaaaaatagattcaaaaatgtacatatggattcccttgggtctttcactaaatgttaagctgaacatgcacagggtgaaattccataaggctagacagagagcaactgggagacaactgtatgctgaacaattcccagaattcacataggcctaagaggcattttcagtagctagagtggaaaaaacttgtttagcacctagggcattcagtgaagacaccagaatggctatttctaaaaagtagacctaaaatgtcctcagagtaaaggatacttctgactcatgttaacaacacttaaaaacaaaccttaaaagaattgagctgatgcgcgaaatcttatatcaactatttaaagaaataaagcaaaatccagacaaccaataatgttacattatcaagaaatcaattaataattagaagatgtgttaggaagcaggaaaatataacatataaccaaggggaaaatcacacaaaagaaatgaacacagaaataacaaacatgataaacagaaaaaaaaactttaaaatggctattacaaatgtgaagaaggccttaaaggaatatataaacatactgagaaaaaatagaaatatttttgttgtttttaattgtttttagacttttcttctatcctttttttttcaacttttattttgagttcaggggtatatgtgcaggatgtgcaggtttgttacataggtaaacatgtgccattgtggttttatgcacagatcatcccatcacctaggtattcggcccagcatccattagctattttgcctgatgctctcactcccccaacaccaagcctccaacaggccccagtgtgtgttgttccctgccatgtgtctatgtgttctcatcattcagctcccacttactaatattattattttttccgaggcagggtcttcctctgtcgcccaggctggagtgcattggtgcaatctcagctcactgcaacctctgcttcccgggttcaagtaattctcctgcctcagcctcatgagtagctgagattacaggcacgtgtcaccctgcccagctaatttttgtattcttagtagagacgaggtttcaccatgttggccaggctggtcttgaactcctgacctcatgatccaccctcttcagcttcccaaagtgctaggattacaggcatgagccaccgtgcctggccctcagctcccacttataagtgagaacatgtggtgtttggttttctgttcctgcattagtttgctgaggataataccttccaactccatccatgtccctacaaaggacataatctcattccctttttatggctgcatagtattccatagtgtatatgtaccatattttctttatcctgtctactactgatggtcattttgggtttattctatgtctttcttattgtgaatagtgctacaatgaacatatgtgtgcatgtatctttataatagaatgatttatattcccttgggtatatactgagtgatgaattgctgggtcaaattgtatttctgcctctagatctttgaggaattgaaacactgtattccacagtggttgaaataatttacattcccaccaacagtgtaaaggcatttcttattctcagcaaccttggcagcatctgttttttttgtttgtttgtttgttttgacattttgataacagctattctgcctggtgtgaaatggtatctgtattagtccattttcatactactatgaagaaataaatgagactggataatctataaagaaaaaaaggtttaatggacttacagttctgaatggcttgggaggcctcacaatcagggtggaaggaaaaggaggagcaaaggcttgtcttacacggtggcaggcaatgtgagagagcaagtgcagggaaactgcctttataaaaccatcagatctcatgaaacttattcgccaacatgaggacagcatggaaaaaaacccaccccatgattcaattgcttcccaccgggttccgcccacaacacgtggagattatgggagctataattcaagatgagatttgggtggggacacagccaaaccatattagtatctcattgtggttttgatttgcatatctctaatgatcaatgatgttgagctttttttcatgtttgttggccatatgaatgtcttcttttgagaagtgtctgttcatgtcctttgcctatggttttttttttcttgtaaatttatttaagtttcccctagaccctggatactagacctttgttagatggataccttgcaaaaaatttcccccattctctaggttgtctgttcactctgataatagtttattttcctgtgcagaagctctttaatttaattagataccacttgttaatttttgcttttgttccaattgcttttggcattttcatgatgaagtctttgcccatgcctatgtcctaaatggtattgcctagattttcttctagggtttttatagttttgggttttacatttaagcctttaatccatgttgagttaatttttgtatatagtgtaaggaaggggtccaatttcaattttctgcatatggtttgccagttctcccagcaccatttattaaataggaaatcctttccccattgtttgtttttgtcagatttgttgaagatcacttggccgtaggtgtgtggtcttatttcttagttttctattctgttccactggtctatgtgtctgttcttgtaccagtaccatgctgtttggtttactgcagtttaatttgaagtgtagtgtaatttgaagtcaggtaatatgatgcctccagctttgtttgtttttcttaggattgtcatggttattcagggtcttttttggttccataggcattttgaaatagttttttctagttctgtgaagaatgtcagtggtagtttaatgggaatagcattgactctataaattacttaaggcagtatggccatttttacgatattgattatttctatctatgggcatgaaatatttttccatttgtttgttttctctctgatttctttgagcagtggtttgtagttctctttgaagatgtccgttactttccttattttatcctcttcatagcaattgtgaatgagagttcattcatgatttggctctttgcttgcctgttgttggtgtatgggaatactagcaagttttgcacattgattttgtatctagagacattgctaaagttgcttgccagcttaaggagcttttgggctgagatgataaggttttctagatgtaggataatgctatctgcaaagataatttcgcttcctttctttttatttgaatactctttatttctttctcttgcctcattgccctggtcagaacttccaataccatgttgaataagaatggtaagagagggtgtgcttgttttgtgccactttgcaagggaaatgcctctagcttttgctcatttagtgtgatattggctgtgagtttgatatatgtgaatcttactattttgaggtatgttccttcaatacctagtttattgagagtttttaacatgaagggatgttgaattttatcaaaagccttttctgcattgattgaaataatcatgtgttttttgtcttttgttctgtttatgtgatgaatcacattcattgctttgcatatgttgaaccaacagtttataccctctcagatatgaagccaactggatcacgatggataagctttttgatgtgctcctggatttggtttgccagccttttattgaaaaatttttatatcaaggttcatcaaatatattggcttgaagtttttgttgttgttgttgttgttttgtatctctgccaggttttggtatcaggatgatgctggcctcataaatgagttagaggggagtccctcaattgtttgcaatagtctcagtagaaacggtaccagctcttctttttacctctggtagaattcatcctttagtccttctggtgctgggctgtttttgccttggtaggctatttattagtggctttattttagaacaatttctcagtctattcagtgactcaatttcttcctggctccttggtagattgtatgtgtgcaggaatttatccatttcttttagattttctagtttattttcatagaggtgtttgcagtattctctaatagctgtgagtagttcattggggtcagtgatatcccctttatcatttctgattgtgtatatttgattctgttttcttttcttctgtattaatctagctagcagtctattttattttattttatttctcttaaaaaaacagcttctggatttgtggggttttttttttttttgaagaattttttatgtccccatctccttcagttcagctctgatcttggttatttgttgtcatctgctagttttggggtttgtttgctcttgattctctagtttttgttaaaaaaatttgtgatgttaggttgttaacttgagttctttttaactttttgctgtgggcatttagcaccatgaatttccctctgaacactgctttagctccatcccagaaattctagtacattgtctctttatcctcattagtttcaaataacctgttgatttttatcttaattttattatttacccaagagtcattaaggagcggatcgctcaatttccatgtagttgtgtggttttgagttcatttcttaattttaagttcaaatttgattgcactgtggtccaagtcttttgcatttactgaggagtgttttacatctgattatgtcatcaattttagagtaagtgctgtggggcaatgagaagtatgtatattatattttgttgtttttgggtagagacttctttaggtatctaccaggtctgcttgatccagagttgagtcctgaatatcttcgttaattctctgtctcaatgaactgtctaatattgttggtggggtgttaaagtctctcactattattctgtgggagtctaagtctctttgtaggtatctaagaacttgttttataaatctgggtgctcctatattaggtgcatatataattaggttagttagcttttcttgtattgaacattttacctttatataatacccttcattgtcttttttttatctttcttgatttaacatctgttttgtcagaaactagaattgcaacccctgcttttttctgctgtccattttcttggtagatttttctccatctctttattttgatcctatctgtgtcactgcatgtgagatgggtctcttgaggacagcataccaatgggtcttgactctttatctagcttgccattctgtgtcttttaattggggcatttagcccatttacctttaaggttagcattgttatgtgtgaatttgattttgtcatcacgatactagctggttattttgcagacttgtttatgtagttgcttcattgtgccattggtctttgtacttcagtgtgtttttgtagtgtttggtaatggtttcctttttcatatttagtgcttcctttagaagctcttgcaaggcaggccttgtggtaatgaatttccacagcatttgcttgtctgaaaaggagcttatttctccttcacttatggagcttagttttgccaggtacaaaattctgggttgaaaattcttttctttaagaatattgacagccaggcgcagtggctcacacctgtaatcccagcactttgggaggccgaggagggcagatcacgaagtcaggagatcaagaccatcctggctaacacggtgaaaccctgtctctactaaaaacatgcaaaaaattatctgggcgtggtggcgggcacctgtagtcccagctactcgggagtctgaggcaggagaatggcacgaacccaggaggcagagcttgcagtgaactgaggtcatgccactgcacttcagcctgggcaacagagtgagactccgtctcaaaaaaaaaaaaaaaaaaaaaaaaaaaaaaagaatattgactattggctcctaatctcatttggcttttagagtttctgctgagaggtccactgttagtctgataggcttcccctttgtaggtgacctggactttctctccaactgcccttagcattttttctttcatttcaaccttggagaatctgttgattgtgtcttgtggttgatcttctcatggagtatcttactggggttctctgcatttcctgaatttgaatattggcctgtcttgctaggttggggaagttctcctggattatatcctgaagtgtgttttccaacttggttctattctccctatctctttcaggtaactcagtcagtcatagatttggtctctttacataaccccatatttcatgcgacttttttcattgctttttattcttttttctctattcttgtctgcctctgttatttcagcaagatcatcttccagctttgagattctttcctttgcttggcctattctgctcctgatacttgtgattgcattgtgaaggatctcgtattgtgtttctcagctccatcaggttggttatgttcctctctaaatagactattgttgctatcagctcctgtattgttttattatgatttttagcttctttgcattgggttacaaataattgtgtattttatgtgtcacaaagtaatattttgatacacatacacattataatgatgaaataagtgtaattagtatatccatcacctgaaatacttatctgtgacaggaacatttaaaattctctcttttaggtattttgagatatacaatacattattattaactatagtcaccttgctgtgcagttgaacatcagaacttttatctcttatctaaatataactatacccatcgaccagcatctctaatttctccatccaaacgcttacccccacagcctctggtaaccaccattctactctctacttctatgaatttgacttttttagatttcatatataagagatattatacagtatttgtctctttgtggccggcttatttcacttaacataggttcattcatgttgcaaattagagaattttctatttgttttcatcttaatgactgaatcgtattcattttacaattatatgtagtactttaccttttaaaatgcccatagttggacatttaggttattttcatatcttggttattgagaatagtgctacaataaacatgggtgtgcagaaatacctttgccataccgattttatttcctttgggtatatacatagtagtggaattttataattatatcatcattctattttcgttctttttaaatttttaatatttaatccttgtgggtacatagtaggtacatatatttatagggtacataagatactttgatataggcatgcaatgtgtaacaatcacatcctggtaaatggagtatgcatcacctcaagcatttatcctttgtgttaaaaacactccagttatactcttttgattttaaaatgtataattaaattattattaaccacagtcatgccgttttcctgtcaaatactaggtctttattcattctttctatttttttttcttttttttttttaactcattaaccatcctcacatccccccacccctgacacacactgagtacccttcccagcctctggtaaatgtcctcctactctctatctccattagttcaactgttttagtttctagctgccacatataagtgagaacatgtgaagtttgtgttttcattcctggcttattttacttatcataacctccagttccatccatgttgtagcaaatgacaggatctcattctttttatggctgaatagtactccattgtgtatatgtaccacattttctttatccattcatttgttgatgaaaattaagattgcttcccaatcttggatattgtgaacagtgctgcaacaaacatgggagtgcagatatctctttgatataatgatttactttcttttgcatgcatacccagcatttgaattactggactatacaatagctctaattttagatttttaagaaacttacatactgttttccaaaatggctatgctaatgtacaataccaccaagagtgtataagggctctcttctgtatatccttgccaatgtttgttatttttcactttttgaaaatagccagtctaacagatgggaggtaaaactcattatggttgtaatttgcatttctctgatgattaaagacattgaactttttttcatatatctgttggacattcatatgtcttcttttgagaaaagtctattcaagttctttaccaatttataagagttgtatttgttttattgttactaagtagtttgagttaattgtacattttggatattagccacttactggatatataatttgcatatatttttcccatcccatgtgtaatctcttcactctattaattgtttcatttgctgtgcaaatgatttttaggttgattcagtgtcttttgtctatttttgtttttgttgctcaaacttttataatcatatctaagtattctgcccagtgcaatattgtgttaggccattattgcattgctctaaagaaatatctgagacctggaaattcataaagaaaaaaggtttaattgactgacagttgtgtagcttttataggaagaatggtactggcatctgcttggctcctggtgaagcctcaggaagcttttagtcatggtggaaggcaacgttggagtagtcatctcatatggtgaaaatgtgaacaagagagagagtgggggaggtgccatacataaacaatcagatcactacagcaaagacagtaccaagccatgtgagatctgcttcgatgacataaacatctcccaccaggccccacctctaacactgggattatgtccttctgaaatttcaaaatataatcatgccttttcaataggacccaaattgtcaacacatttttgaattaactcaaaagtccaaagtctaaagtttcatttgagacaaggcaggttccttccacttatgagtctgtgaaatcaaaagcaagttatgtacttccaagttacgatggggtacaatggggtatagctattgaataaacatttccattggaaattgaagaaatcagccaaagggaaggccctgtgcaagttcaaaatcaaacagggccgtaattaaatcttaaagtttcaaaataatctccgttgaatacatgtcatgcatctggggcacactagtgcaaggggtgggcacactagtgcaaggggtgggcacactagtgcaaggggtgggctcacaaggccctaggcatttccacttatgtggctttccaggtttcagtccccatgcctgctctcacaggttgttgagtggctgcaacttttccaggtacaaggtgtaagctgcaggtggatctaccactctgggggcctggaggatggtggctcctttcccacagctctactaagcagtacctcagtgggtacactgtgtggtgccttcaaccccacaatttacctccacactgctctgtcagatgttctctgtgagggctctactcctgcagcgcactttttcctggggacccaggctttctcaaacatcctctgaaatctaggcagttgctgccaagttttctttactcttttactctgtgcacctgcaagattaacatcacatggaaactgtcaatgcttatggcttaaaatgtctgaagcagtggctcgaccttatcagcctggactttaccgtccatatcactatcaatattttggtcacaaacatttaaccagtctctaagaagtttcacgttttccttcaacttcctgtcttcttctgagtcctccaaagtcttccaacctttgcccattatccagttccaaggtcgcgtccacattttcaggtatctttatgaaaataacccattcctggcaccaactttctgtgttaagctgttcttgtattgctataaggaaatacctgacactgggcagtttatacaaaactaggttttattgcctcatgtttctgcatgctatacaagaagcctggtaccagcatatgctcaacttctcatgaggcctcaggaagctttcattcatggcagaaggcaaagggagagcaggcatttcacgtggcaagaacaaaagcaagaaagatagttgggggagaaagaagagatgtcatgcatttaaacaaccagatgaccattacaaagacagcaccaagccatgagggatctatctccatgacataaaccactcccactaggccctaccttcaacactgaggattacatcacaacatgagatttggagaggacatcgaaactatgttaaatgtcacacagtttttttttttctgttttactctagtaattttattattttaaatcttatctttaagttgttgttctatttttagttgattcttatataagggtgaaatcagggttcttttttttcttctgtgtatgaatatccggttttcccaacagcatttattgtagagattatcctttctccaatgtggattcttagcacctttgttgaaaatcaactcacactagttacgcagggttatttttggactctcttctactacattaatcaacgtgtctatttttaggccagtatcattctgttttgattcctatagctttgtaatatattttgaaatcccattgtatgattccattagctttgtcctttttggtcaagattgctttgagtattaggtgttctgtagtttcatatgaattttaggattttttctagttctgtgaaaattcccattggaattttgatacggattccattgaatttatagatcaatttgggtaatataaacattttaacaatattaattctactaattcatgaacatgggatatctttttcatttacttgcaccttcttccatttctttcatcaatgttttatagttttcagcttacagtttttcactttcttggtaacatttaattataaatatttttattgtattataaataacactgttttttaaatttttttctggtgagttaattgttagtgtgtagcaacactactgatttttgtaagttggtattttattttgtagcttaactgaacttttaaatatgttgtaacaggttcttagtggagtctttaggattttctatatgtacatacattgacaaatccgaaagactctaattctgtaatggtggtggataaattaattatgtgtctattataaagtgtaaaaacaaaactattaaaaacaaagcaacaataatttgttaagaggcacatattataaaaagatgtaaagtataacaccaaaacagtaaaaaatggaaagagagtaaaattacagaatttttctctgcaatcaaaattcaattattctaaacttgaaatagcttgttacaagtataaaatgtttcttgtaaacctcagggtaaccacaaaacaatattttataacaaaacacaaaagaataaaaaagatatccaaacaatgcagtacagaaggccatcaaacatcaaagcaaaaaagctagacagaaataaaaaaaaaggccctaataaaacaccagaaaacagttaacaaagtggcagtagtaaatccttacctataaacaattacaaaaaaaaagtatatgaattaagtgtttcagttaaagggcttagtgtagctgaaggaatgaaaaaaacaaagcccagttatatgctgcctacaatagactcatctcaacctaaaggccactcatattaaaagtgaattgatggagaaacacgttaaagggagacagaaactgaaagagatcagggtagctatatttcatttataaaaaataaactttaggtcaaaaactgtaaaaagggacaaaacagttaatgacaaagtggtaagttcataaggaggaactaacaattatatttgctccaaaattggagtacttaaatacaaaacaataataataaatcgaaaggagacatggaatgtgacacaatagtaatagggtatttcaacactccactttcagcaacagacagatcattcagacagaaaatcaataagaaaacatcagacttaaactacacgtaagaacaaatggacctaacggatatatacagaacattccacccaatagcaacaggatatacgtttttctcaagtgcacaaggaacgttctccaggatggattatattttaggcaacaacacgattcttaacacattgaaataaaaagaaatcatatcaagtatcattttccatcgtaatggtgtgaaactggaaatcaataacaggaagagtcatggaaaattcacaaataagtgaaacataactaatacactcctcaacaactatttagtcaaagaataaactaaacaggaaatttaaataatatcttgagaaaacaagaatgaaaacagaacataccaaggcttatgggatgcagcaaaagtagttctaagaagggagtgtataacaattaaaatctacatcaaaaaagaagacagctctcagataaagagcttaacattacatcttaagcaattagtaaaagaagaacagactagtcccaaagatagcagaagaaagaaaataacaaaggtcagagcaaaaataagtgcaataaatacatgaaaaaaatagaaataaagagaataagagttggctttttgaaaaggtgaataaaattgacaaaaccttagctaaactaactaagaataaaagagagaagacaaataaataacatcataaatgaagaatgagacattacaattgataatacagaaatacaaaggatcataagagactattgtgaaaaattatatgccaacaagttaaaacacctggaagaaatgaatcaattcctagaggcatataacttactaagacttaatcatgataagatgggaaatcttaacagaccaataacaagtaaagagattaaataaaaattaaaaagtctgttcaaggaaaagcccagatccagatagcttcatggatgaattctaattaacatttaaagaactaatgccaatcattctgaaactcttccaaaaaattgaagagaaaaagagtacttccaaactaactttacaaggccagcctcaccatgataccaaagctagtacagtacactacaagaaaagaaaaactgcaggctaatataactgataaacatagatgcaaaaatcttcaacaatatgcatatggactccaacttagggtggttcaatttaagattttttaactttatcatggggttatgaggataatatcttcaacaatacattaaaagtgtcatcatttaccatgatcaagtgggatttatccctgggatgcaagattggttgaacatacataaatcaataaatgtgatatgtcacatcaacagaatgaagaacaaaatcaacaccatcatctcaatagatacaaatgaagcatttgacaaaacttaacatcattttatgataaagtctattaacaaattaggtaaagaaggactattcctcaacataataaagactatatatgacaagcccacagctaacatcgtactcaggaattaaaattgaaggcttttcctttaaaatcagaaaaaaataagtatgcccattctcactacttctgttaaatatagtactggaagtcctagccagagcaattaggcaagagagagaaataaaggacatccaaataaaagaggatgaagtaaaattatctctgtttctttgcaaccacactgttttaattgccagcaatgacatgattttaaatgtcagtaaaaggcaaatatgaatttttcttcaagtacaacaaaatcaaggaaactatgtagttactcatcatgtttttcaaaggcttaatagaaattcatgagacaaaattaataaaataaaaatataactcaaggcctcaaaaatttataatgattaagcaatagaattatctacagtcaatctaatgtatttacctctacttatctccccatggtccaaagaaccatcgtctcagacctaaattatttcaaaaaaacttctaaatgctacccctgcttcttcccttgctactcatcacagatgattttttacaccacaggacaaacagtcttgctaaaacgtaggtcacagaatcgttctttgttaaaaattttcagtgtttttctatttcacttttaaagaaacaaatacattatagataaattctaactaatatttaaagaaccaccacaccaaaaatctcacagtttttaacatctctgaattcattaattatttatttgaccatgctggcctctcttgaaaaaataaaataaaataatattctaggcacgtttctacctcatagcccttgcacttgctcctcctgctgcctggaacagtcttctcccagatatcctcatgactttcctccttaccagattctcgtctttacttaaatgcccccttttcattgcagtcttccttgtccatgctacaaaataatcctgcccctttatcttccttttctactttactatttgatagcttttattccatcaactacactacctattgcatttattaactttctgtctacactaatactacaatgtaatctgcacgagtatgttctgtgcacttacgttaagtgaccaaatggcttaaatttagtagacacttaaatttcagttgaatgaataaatttctttggtcctctctagtgttgatattctgacagctaatcatattatacataattgttttgttgatggaaccaccctgttacacgtgattttaagtctattcacaagtccagtcctggcaaatgtttaacaacaagatttctgatgaaaaatgcccttatttgtagaattttattaattccatggtgaacattctctcaccacaaacacgggattgagataaaatgcacacaactgctttttatgagctgatgttggcacaaattatagcacaaattgcattaactcatttaatgtgctcaatcaccatgggagacaggagttattactttggccatttttcaaatgagaaactacaacacagagaggttaagcatgtacccaaggtcacatagttagaaaggaatctacctgggatatgcctgatgattgacccgagagcttgtgcttagaaaaattcagctatacttcaggcctttgataaattactttaaataaaattcaggttttaaaatgaaaaaaaaaaattatagccatgcatattctttaagtgtcagtcaaggacctataaatattttttaaattttttgaatatttaaaaaaatgttagttttccaagcaaaaggccaagactgtgtgctttgcttaggccattttattttcagacactgaaaatatctgtaaaaatgataatacctcactctggtttgccagagccaattagatttgtcagtatcagtctatatcttattgatcgaaaccgcaggtagtaaaaaacattcgtgtgttttctaagtgttctttcttgttttggattccttgcttaaatcagaatcttactgaactagaaataagaaagtttagactccctccttgtttttaggaatataatgtacctagctgagtggatttctatttttcaaaggcacaataatccagttaaaatgcagtgattctcttaggtactacatagattttacattgtataatcattgcaatcagccaccaaatccataactctcattagaaagcagtgtttcttttaataccattaatttagcctgttttgaagtccttattaagaattcacctagctaaaccatgacacttatatggattcgacaaacttgctctattgcctctagttctgaaaatagattttaattatcatataagattaattaaaagaaaaatgtaattcagtattacctttattttttacatcatgaagcactgagtaacaacatctatatactacgcatattgtgtataaaatcaatgaatgtataatagctgtatggaaaacaggtttaaatctaaaccaatgaaccacagcactaaaaaattaagcaaatgtttattacatcattttggatattgacctttggatatagaaagaaaacattttgaagaagaatctgagtctccacattttatttttagaggagtaggtacttctggacaccatctggtcagcccatggcattcaaaataaaacagtgtttggaatattgaaattaattattaaaatgacaaggagaattttaaatttctaacttgcagacatgggataattttgactatttctggtataaaatgacaggaggcatatctttctggcagagttttgatcttgtgaaacagctgcaacagaaacacatgaatgtttttctaaaaactagatttcaatctccacttcaacttactggatcaacatacataggtaaggctcttcaaacctagaatgcaaggatttaacgatgctgctattaaaaataaagtaactaatttctttcacataaatcattatttgttaattttcaaatggattatacacccacattttatttctttttggaatcaaaaatggatttagggccaagattttagtagaaaagaggtttctttgtagaaaaaaatattgcagaaaaaatactagtaaaaacattggacacaaaaatattagtaaaaacattggatgtgatagaaacagaagtgttaaaagaaatgaagaacaaatcggggcatggaaaatgtatttcttcttaaaaatatttgtaaaagcatgagatgcagctatctttacaattaaattaaatgtgtataaatggagaagactgaactataatccaaatactcagtaattctagtgaaatttgacatatgatagatcaatatttgtgaaaagaatagtttaatcaaaatactaggtcaagtctcttcgcaatttttctttatatagttgaaattaagagggacagcctggagaatattctaagtgtggcggggcctataatcacaataaaatattgatctgctttctcagatgatggcattttggatacacaccactctaagaaattaatcgtacaaaagcaataaatgttcatttgtgagatagtatgtaaaattctgatagaatttggtcacttattgttcatttttaaagtcaaggaataaagaaacagtctatgaagagtttcagataaaaaaccaaatgataggctaaacgtaaagctgagcattagtgttacttgacattctcaggcaacctgcaatgtgttatgaggcccttacttaattttcagttgagataagaaagttaaataaattatcattcatagaagtcattaaaacaaactacacccatgcattttccagccagaattcactgtaaaattttcattatgtgaaaaaaacctgatgaataagaataatgactttttccataagttggcacacttcccaggctagaacacaggagaacctatctaccaaaaactatgtccttctactcccttcaatgaataaactactgttttttttaaaaaaagtttatttctctcacacattaacaaagattagaagtaaacagttcaagatttgcatggcaactctgtgattatcagattatccttctactgtcaaaatgtcatttccaccttctggaccaagatggctgcctgaggtctagtcatcagagctgcagtatgatgaacaggaaaaaataaaggatgaaaaagggagcatcctcgtcctttaatgactctttcacaacgttgcaaacatcaaagagtgaactgatcttaatccttcaaaataaacaagagtcaggaggatttcaatttgaatcccaagtgtattttgggaatattttataagactaaaacaaagtgttttatgttccatgcctcagtttctctagctacaatgaaaatataaaattctgtattattcatcttccttactcaggggctagaggtgataacaagaagagattgatatgcagttcaaatatagacatgtgatagtgatacttcataacataaaaacaatattttatgactaatgggcagaataaatccttcgtctttctggcacaatatgcataacttaaaagaatgtcagagaaaaaaaaacaacattagaatggaagttgttaagaactatttaaatgactttataaccgtgtataaacttacctagaatagggatgcattgaattgttttaaataaaaaattttcttaggtcagaagggaaatcatttttgtgactgtgtgaaaaatacattctcacattggataccattccacaattaatctactgccctttttccttatgcccattatattacgtatgtattcttggcattcaaagactgcacatggtattactctgttttgcctatacttttaacaatatatttcaggacctttttactgtgattcttcaggatatttcaaaaagtattatgaaagatggtagacctagctgctggataactgtatttactgacaataaaaattggtccacttaaattttaaggagataagacaatctcaagtgaaatgaaaatcaataactggtccgtttttatctgacatactagctaagccacatattagagattaaagttagaaattaaaatgaacacaatatggtaatttcttttttggtgttagatgttctttcctccatagaagagatgtgttctagacatttttttgtgtgaaatgaatttatgttaagtgaatcttcctttctgatagaaaattaaaaatttattctgttgattataaaacaagttcttacggacttgacctttgacaaatctcctattggtgcttggtaccagcatgagctaactttatggcccaaagcaacaggacagtgtgctgaggtctgggagcaccctctccagagaatccctaatgtccaaaaattggtcaaaatctaaaatttattttgctgtacaattcacctttttttctggagttgtatttgccttcaacgagtaaggcaagatttcctgcttctgtgatgatggaaggccaataactcctttatgaagtttgattttgctcctgcagggaagatgagtttgagttttttcctgtttctaggatgatagagagcagtcttcagcctgagacccatccctaggtaaatagctgagttagggttttgtcttggctaaggtgtaacaaccagctggtcttaatttctctctaccattagaacattctgcgatcatattgttggggtattttgttgttgttgttgtgtgttctggtctttcttccatcagatttgaccaactctacctgacatggtcaaattcaagtgagaattccaaattataggtaataaagctgctctaatctggtcaaacttcttcgcagcttcaaaagaagaaaaacaaacaaacaaacaaacaaacaagaaacaaacaaaagtgctcggtttctgtgtttgcttcctgtctttaaaataaaatgttattttgtgtacttttcttccaccctatatctccttctccctttgccatctgcagtaccaaaaaaatctgaagaaggcttctagtgacttgaatccctttaaagaattcaaaacaaaggcaccacccactccttttggggtgttctgttttctttgtggagtttcaagagtcataggcagattcttcttaggtctattgctctgttttcttatgtgaaaggaaaatatcttgggcccccaatgttactaagctaaagaaaaaaataaaattcaagcttggaatttcttagggcaaacctgccttacgttctattcaaagtcatttctctgttcactgagataaatgcaaatctgataacttcctttaaaaaggttaatcagaaactcaaaagactgcaactgtttgtctcccacctacctgtgacctggaagccccctccccactttgacttgtcctgcttttgcttccagttgtcctgcctttccgaaccaaacaaatgtttattttacatacgttgattgatatctcatgtctccctaaaatatataaaagcaaggtatgctctgaccaccttggacacatgtcgtcaggacctcctgaggcaatgtcacaggtggaccttctcaaccttggcaaaataaactttctaaattaactgagatctttttttatcccatatatgagcaagtattgtacctagagtggacaagtccctcctcttactttcaggaacaccctactctgtctatagagtagctgttctttcaccactttactttcttaataaacttgcttttgctttgcactgtggactcggcctgaattcttttttgtgcaagattcaagtaccctctcttgggtctggatcaggacccctttctggtaacactgttaaaacacagaaaagtattgatgttgcaccgttcacattacctgaacgtattggtctgttttaaggcatttcttgagattatgcatgaatttttacaattggcttggaagggaggcaattgaagtatgaaagtgaagtgtaagaaaatatatcctggactggtagtgccctggcaactgtctgcttgtgttgagtcctcttctcccaatgtaaagacttgttatttgacattcagaggtatcatcattaggacacattagcaaaatagtgtttttgatattgacaaaagattatcatgatgctaagactagcaaaatattgagaattagctagcttcaacaagcctgaagtgaagttatatatgcatatattagttagcgttgctttcaggaaaatgagtatcaagttagatattagccagttatgaatgtctcattttaactaatgcaagtgatgttactgagttttcaactgaacacatgcagttgatgtatttattaatatttgaaggtagaatttgagactatttgatttcctgaagtttgaaatacgttttcataaatccttattgacaaacatgtatatgtctaaaatatgttttaattagcttaatatttattaatgtaacttttgactatactataaaaagtcaaagggcactaaagcgcttatggagaatagcagtcccatgtgccactcctccagagcaagcacttttaagttttatctcttaattcatgtgtttgcttccacatttttggataatagctttgattgctatgtttgtattttttctttccatataatatgtattgacttccttttttggtagatgagaatttagttatctcactctactttatctctctttcaacattatcaatagaattacatttcaatttttcttaaattaatattcagtggttcatttgtcaggagtatgtaaatactgcccacaattgggccacatagggtgctgtagttacatttgcttttttgtacaactctttgtcatatcccagtgttaactttccatctttttattggcctaattcaatttaatttaaacattattaaatatgttagatctgtaaaagaccttttaatattattttttcaggcattcaaacaaatgaactcattgattcatttcttttctttctttttctctcaagggtttcttttgacattctctggtcttcttgatctcagctggatctggagctctctaagatgaaattgtagctgacaatgactttcctcataaatctataatagcttaatataagctattatgtaagcctaataaagcttataaggggctttctatattaagcagctattctttgtattgcttacccttctcttttcctaatttactacccgattttatgaagcccatatgtggttggcaaaattatttgaaggcctcaaagattcctgactccttattccagttacttatcttgtcccagttattcaatcaaattcaaatctaggtactgctgtgtaaggatatggcagatatatttaagtgtttaaatcagttgatcttaagatagggagattatctgggtgtgtcagggctaattacaagagccctttaaaatcagagccttttctccagctggtcatagaaaagaaagtgagagttatgaagcacaggaagacctcaagtcagtgttactggtttgaagatggagaaggtcgcatgctaaggtatatgggaatgtgggcagcctctaggacatgaaaacagggacattacatctactaccatgaaaatttgatttttgccaacaacctcaataaactggaaagcagattccccctcagagctttcagataagaccagtctttctggcgatattgatttcagtttcataggaccttaatcagagaattcagctaactccagccaaccccagctcagacttctcacctacagaaatttgagataataaatgaatgttcttttaagctgctaaatttgtggtagtttattatgcaacaatatgaaactaacatgacatcattcatcagtttcttgagataatttataatttcttaaatgcttaaacctatatttgatactgtgtttaatatcttagtttttacttgtcaacatattccatatttgaatatcaagatacatctaatggtcacatactaaaatagatttcttaggtgtgtttgaggtgagtacctttttaatcacctaagatatggtgatggagtctgtatagtgttgattcaattaaagtttacatgccatcaaatgtacccaaacttaaacctaggaaaagtggtagcagcatcttgaagatactgtgttatcttttttgtataagtttatctatcatttataaatacctattgtgttctaaacatcatgatataacctgcgaggaaacagcaattagcaagattaagtgtggactctagtgaccagaatatgctttgctttgatgttttaataattatgcaagcttttttcaagaataaggaatgcgtcgtatactcatacctcctttcaaaaagttgagcagtgaaaaaaattaatcaaagaatgtattgttttgactctataatggtaaacaatcaatttatttttttcttactaaatgactttgttggtgaaacgtagcagttgtcatattacgacttctcttgcttcagaaattaatgaaaaacacactagtctcctgaacaagtcatctcagataactttaacaaatctattgaaaataacatcttggtttttattgatattcgaaatagcactggataaataaatgcataaaccttctcagtttcccgttactctaaatggaaaagttgtaaaaccattcctttatattcgccacaatggcagatctgttccatgaatggtaatgcatgttttaaggtattaacaaaattgattatgtaaccctagatatataatggaacagaaggctaatgcttatgccgattctgccttaagtaaaatccatctgtttactactaaggtagcatgcaactcagctttgtttgaatagaacaagatgaatacttgaggctattttctatctgctaagacaaaagtgtagggaaacacatagtaaaacttatattttttaaagacacggttcccagcaaactctaagtatttactgtctctcgaatatgatcaacccagaaaagccacatgataggatacttgcaaatcttcccataaaccccagtcaacaatcatgtgcatacaagtcctggagacactcacagagaagcaactgattattgaattttatgtggaaggaattgagatgaacagttaaagggaaatttatattagattttttcttataggtctgcagatgttttctttttggaccattataaaagcatgaagcatagctttgaaaatgttattttaaaaaatatgtttctgacataatcatttatttctgaagaaaatgctttgttcatattatagttgatattttcaatgagatgttttgattagccttatcaactcttcagtatttgccaaataccctccacccacagtcatgtttcttttgtgtatatagttctattaaagtctggtaatttttgagatcaagatcaaacaatatttcatttgtgaaaccttctataactgctgtgctttcctctgcacttgactatgtttgcttaaacttctaatagagtgattatttcctttttccttgctatgtttttaatgatgtatatttccctcaagtcggtcaaattgcaagctccttgaaaacaatgatatgcatcagaaccagaaccttcatacaagactcacatagtggtgacttcataaatgccctgttgaattgaatcttaaaaagtaatccatgtcatccatcagcaaggaaagaacaattagtatatcttgattgcggatcatttgtttccttaaaattacccagggagaaaaaattggatgaggccaagagtattcctcatagtctgctaaatatagccacaacctagggtttcataggaatagcaagaaaagctcttggacacttgaaagagaaagagaagatacagcaatgcaggactgaggctgataataatcagcaaatttacaaaagacagaaatatttaaaacccgtagattttatctctttgaattactgttttatatttatgtcttatgtattacctaccagaatgttgttcatattcacattatataaatgtgaaaatactttgtgaaattctaaggttacattgaaatgacttctatcattattatattacctaaccaaatattggctttgtaagcatctctttctgacatctcaacaatcaatccccaaacaaccaatttcttttctagtatcctgctctttaaaagcaccaaagtataggtctatactgtttcacaggcagaaggtcccaaagaagttattaaacatcccctcacaggaaagaccctgaagaaatatccctttgaagtcatggcaaacataataattggcttggtaattaaggttttgtattcatgtaacaaagttttcagtaaagcatttattagcatttatcagtacttaaagaggagtactctcagtttcaagaagacctcactattgtcataagatagaattgaaccaatatataatttgcaccgcagtatgtaacaagtctcttttagaaacaagacaacctgcatctcttattttttatatttccgttaaaataatagatgagtcgaaagccacttaagaatttacaagagttatatttacaaacaaattcatacagataacactgttgttttgtgcatttacaaaacacaacacatttatttagtcttccgcatgaaaagccagttaaagtagcttgttaccaaaaatgtgtttcaggagttgcctggctcccttataacttacaaaacttaaccatttgttacctaaactaaaaaagtagatcaataattgttttatttggaggaaagagtagcttccacgttaagaaacgatatctaagagaatatgatcttcacatcagtgctaagctctgtttctgcatctgtgagttaaagtctgttaaaattgcttcattataaatgacattcaatgactgaaggtctacacaagaggagaaaacggagttctaaaaagccactggtacatgctgaagagttcagacaactaagcaatcattttgccaaacaactgttttacctatgccaaatttctatcaggttctcgaggcacaatgaatgcctttttatttttaaaacaatttttattttatttttttaggttccgaggtacatgtgcagaatgtgcaggtttgttacataggtaaacatgtttcatggtcatttgctgcacctatcaacccatcacataggtattaagcccagtatacattagctgttttccctaaaactctctcccccaacagtctcccccaactggcccccgtgtgtggtgtgcccctccctgtgcccatgtgttctcattgctcagctctcacttataagtgagaacatgcagtgtttgcttttctgttcctgtgttagtttgctgagaataatggttttcttgaatttaatacaaaataacttatctcaagagaaaatacggataacctcttttgcccaacactgagaattatgcaacaaagacaaggttgcattctagatgttgcaggaaagtttcaactttgtgatttatgtaattttcagataatacatttcaatttgtgttcagtatatagaactgatgtacctcaacatttctcctatgtttttcttttaactgataagaatgcagaatactcaattcagagcccaattattgtatgtaattatctgctatgattaacaatatcaaagtcattgttttcattttattgattttgttgtaattttatttttgattattctcttttgcattatgtgtaaatttaaaagccacaaatcattttttgaaagaatataggacatcgtaataacttccagaattccttggaaatttcctgaactcttttgtttcttagcctatttaataaaggctgtgtactttcatagaattcacattttgtattttaattttaatcctagaatttggtttctcagacttcaattaatgattcctggagggcagtaagaaaggcagcctgcaatttcacaaaatcattgttctatttgatgatttgttataatcaaataagcatttttttaaaatttatttatgtctttgagatgggggaaaacttataagtagataggcagtgatggaacttaaacattactgtatacatttgaacaaatatatttaattgctagttaatattgttaggttctgtgttcctacccaaacctcacattgaattttaatccccataatccccacatgtcgtgggagggaactggtgggaggtaattgaataatgggggcagtttctcccatgctgttcttgcgacagtgagttctcaccaaatcttatggctttataagtgtgtggcatttgccctgctggcactcactttttgtcctgcagcactgcaaagaggtgacttccgccatgattggaagtttcccaaggcctccccagtcatgcaaaactgtgagtcaattaaacctttttttctgtataaattacccagtctcgggtatttctttatagtagcctgagaatggactaatacagtaaattggtaccgaggtagtggggtgctgtggtaaggatacctgaaaaatgtgaaagccactttggaactgagtaacaggcagagtttgaaatagtttggagggctcagaggaagacagaaaaatgtgggaaagtttggaacttcctagagacttggaggcctcagaaaataggaaggtgtgggaaaggttagaacttcctagagacttgttggctttgaccaaaacgctgatagtgatatggacaatgaagtccaggctgaggtgatctcagatggagatgggaaacttgttgggaactggaataaaggtgattcttgcaatgctttagcaaagaggctggtggcgttttgcctctgccttagagatctgtggaactttgaacttgagagagatgatttagggtatctgggggatgaaatttctaagtggcaaagcattgaagaggaagcagagcacaaatgtttggaaaatgtgcagcccgatgatgggataaaaaagaaaaacccattttctggggagaaattcaagcctgctgcagaaatttgcataagtaatgaggaaccaaatgttaatcaccaaaagggagaatgtctccagggcatgtcagaatccttcacagcagcctctcccattacaggcctggaggcctaggaaggaaaaatggtttcttgggccaggcccagggcccatgctttgtgcagctttgggccaccgtcctccagaccctagaatggtaggttaaccaacagcttgtgctgtgccgtgcaccggaaaagccacagacactcaatgccagccaatgaaagcagccaggaggggggctgtatcctgcaaagccacaggcacggagctgctcaaaaccgtgggagccgaactcttacatcagagtgacctggatgtgagacgtggagtcaaaggagataattttgggactttaaggtttaatgactgacccgctagatttcgaacttgcatggggcctgtaccccctttgttgtggccaatttctcccatttggagcaggtatatttacccaaagcctgtatcccaattgtatctaggaagtaagtaacttgcttttgatttcacaggctcataggcagaagggatttgccttgtctcagataagactttggacttggacatttgggttaatactgaatgagttaagactttgggggattattgggaagtcatgattatgttttgaaatgtgaggacatgagatttgggaggggccaggtgtggaatgatacatttaggctttgtgtccccacccaaatctcatcttgaattatagtctccataatccccaagtgtcctgagagtgacccagtgggatgtaattgaatcatggggacggtttcccctttgctgttttcgtgatagtgaggagtgagttctcatgagatccgatggttttataagcgtgtgacatatcccctgctggaactcattttttctcctgttgccttgtgaagaggtgccttcagctatgattgtaagttttctgaggcctccccagtcatgaggaactgtgattcaattaaacctcttttcttaataaattacccagtctcaggtatttctttatagcagcatgagaacacactaatatgctagcttaaattagcaaaccatttaaaatcaactaccccaatgtggtgaatcatacctttagcccagatatttcctctgaataccaaggacatgtttcagtgggcctattcaaaatctccacttggatgtgtccagggcttcacatgcttaaactcctggtagatgctattatcatgatcctctttcacatgtagtactccaacagtctcctaagtattctaccttccaatttattatctctgcagtaacaggactgcctttttttcaaattgcaaatctaatcaaacctcatcatcatctacaatcttctacaattaaataacttcacatcactctgtggttaaaagaacaaaaataaaaactttggatcatgaccttcaagtacctgtggcttccccttaccactttagcttcatcttcaactgtttccccatgatttctactctagtcatgctggccttctcatatgcccttgtacttggaaagttcctacctaccatgggttctggaatagtcttctcttcctctttctcttcttattcattcttactttatagatatcacctccatcagcacagtcccagaacttcaccttccctgaattccaagtctaggtcaaaaccactcatgacatcaggtccttctctttgtggttattttattaatatctattgcttcttatgagattttaagtaataatgtaaggaattgtgtctattttttctaaaagttgtatctaatttccaagcctaatgcttggtttatagtaggtattcaatataacattcattggatgaatgaattggggttaatagaaagatgtcaatcattctaaatgaagtcattctaaatgtaacaatcattctaaataaaaaaaattatttagtaatgatgtttaatgaaatcttattactttatttctaaaacctagctagtaaaaaattgacactaaaatgaagagaaaaaacatgttttagaaatatgggtttaaaccaatgatttgaataaagcactggggtaagcaagaaagggttttggataagtccaggataacatgacaagtgctaggtaatttggagatggaggaattctaaatcaaactccacctctttataactctctggaggctcagtttctctattgatgcttacagtgaaacagcatcctttaatagctatattgaatttttaaaccattgagtaatttgtagcagctttctatacaagttagtggtctcagctgtcagtggataagacaagttctactagcttctgtcttaaaacataattttagaaatgaaaattctggaaactgtgtttgatgaatgtaaatatagcctagctgaaactctaagacattggaactctgattctccttgaagagaaattgccatttgctacagagaataaaatacatggagattaaaatatgctgtgctggtgattttaaaaagccatcaagagaattaagttaaaaatcaaagatgaaactgatgaaagccagacccctgtctcattgggtactcctctctagggtagttaagatacctggatggccaaaagaaaaagttacataggctatgttcagagaatgtgaaaacagtatttctgaataataggatctttacaatttttatttcattagtgaaagtctttcattatttcccagtattctgctttcatctataattttccctcagatggccacctacattaaataaaacaaatggtactatagtgtcactgactgagaattgtgaagaatttggggatctagagttggaagaactctaatccaatttagtcaacatcagtgtacaaatatgcacattgaattagattatggttgtcctccaggtggtagcatttaacctctgaaggaggggtaaaatgtgattttaaatgttcaagtattctgggacttcttaaaggctgtgagatattgtgaagtttagttatattaataaagatattggtaatgcatttgcaactatgattttgtagaagaaaccttgcagaaaaaaagatactaagtaaaatgtagatatgaagtttagatgcaattacaaaaattgctcatattaaaatattattgtattaataatgcacccttgtaaagcatggttttaaatgttgaagtaaaacaaattactttttatcatatgaaatagtttcatttttaattgattcctttacactgaaataaatacagcaattaaattacacttaaagatatgacataataaaaatatttcttgcctttagtttgatacgtaggtatagatggtttttaaccttttaaatagtgttcacctttctaactcttgctttggcaaatatggaaaatattaggaggaaatgcctttgagaattactattatctagcgtgaattttaggacacggttagtaatagaactgagcatttaattataagatagctggtgatggtaagacacgagaatgaaaaaaataaccattaatataattatttccaaaatatagagatcattaaagtttagaatctattaataagcatttttactcaaacttcaaatcttatattaattaattttgcctttattctagctagaatagtgtaatacagcagaccatttctgaataataaaatgtggcataaatgaggtgctgccacagcacgcattggattaacagaggataatttgggaccctgacatcttaagccaggataacagacgcaggctacatttaccttaagtggagatgaaaacactaatcattatagccatttgctgttaacagatactttacagtatttattgcttttctccaagaatggcttcataacaaacattataaacacgttgcaggcccacgggaaagatttgcagtcaaatgctgtctcacgctaaattagattaacagtttcttactcgtctctaggccaccccccactttgtatatataccagctcatctcatgtccttagcaaataccgtttatttttacactcagaattataatacatatgccaagatcaacaaatagagagaaagtgagccataggttcctccccccagacatatgataagtattaataattgagtacaacactcctttccactgatctttatctgatcttcatgccaaaacctttctcagtgtagtattccaggaagctactaacaagtgatgcaacctcatatgttgaaacctctttgctattgtgggtctatgccagtactttcaagtctctttgactttatagcacatgtaggtcatgaaaaatgtggacaatactttgcattaacagataaggctgcccataactagagatcatgaatctgtgggttagagaccacccagaatgctcatgagatacgatagctcagaacccacttgctgagctctgactgatcaaggtattggcacagtctatccaaaagtagaaacaacactggcagggcaggatctgacatcaagtaaggttttctttattctgtatttgctgtgagtgttattagctgtcaagctgtcttcataattgtaagacagttcacaacatcataaaaaacttattttcccaagccatggattaggtctttggattcaattaatctgatacaggtatgacaaagcattctcttttcaaacagtttatcttagagatacctgcagaatttctattagcatatatttccgtctactctagtgctaatgatcccattatctggctatgtgttactgtaattgaaattagctacagttatatccatcatcttagccctcatagtcacagataaacaatgtggatttatagcaattctaccttggcattgaaaaggtatccctttcagtttctgccttcaggtaaaatgtatactatgtggcttactatttctgatgtgttgattctatacccttttgaaacattttttttttgaaactagtattttggatctgatattaaaattcgttctgacctcaaattcatttgcattacagtgtaatatttcctccgtaatttatgtcatatatgatctagaaggggaggtatgtattaaaataattatctcattcaatgcagataatagctttaaaatatatcgacatgcttttccttataattttttgtattcagcttgagctcccctcccctgacaaagagccacccacttatttcctgaaagaagggggtgggtgggtatattaagattattataacaagaaagcaaagacagatagtttggtttttagattttggttcccaaaacagggcacagtggtcagatgtgggtatattggcttcttcctctgtatggacacactacagaggagagtttggcagtattctcagagcagggaaagtctgacagtagcctggggaaatggaaataatcataaagattccccacattagcctaactctggagcgacaaggtgccacacaggcattaagttaggaacgcctgagaaagacgtcttgaatctgcatttaagggcagactctaaacaaccctattcattacagattgataggaagaaagtagccaagatatttttaccagacccctaagggttgggaaaaccagtaaatcaaaattagtctgggactgatgaaaagaagccacaaaatacagagatctcacagtcataggccatggcaggaacatgaacttcagcaacatatatctgcgtggaggacaaaattttgtaagaggtgcagccgcatttcagtgtgcgctgtcacaggacacgaacagagacacctcactgaactggagaccagtagatattcagagcacattctgcagttcacaggattcttccctaagatactaactttgaaatagagaatatggcaggcctactgaaagcaggaaagagcatcctgataggaaatttgaatgttgtattaaatccgaagtgtcaggtctatgtgaaacaaacaccagataaaaacaaaataagacaaaaactatttcaacttgaataaaacaaatactttaagaaaaaaatcaattgagctataatttacataccaccaaatgtattcattttcagtgtacgattcaatcatttttagtaaatttacagagctgtacagcccttaccaattccgatgatgaggaggggtggaatgggggcagggaaattaacaattaaaagtaactcacttttacaacatttcaatcactttattatacatacgcatacagttatgcatatatacacagattatatttatgaacatttatatatatataaacataatgaacctcttctataaaaaagtgtttatttttcattattttatcaattatttatataattcattcatttaatgatttttatattgagaaatatggagaacacaaagtagaataaaattgtctttctgtttaagaatttcatagcttggtgtgaaagatagtcacgaaaacaaataatgacagtacttgatgaaaagttttatgacagatgtattccctggaattatttcatctctttcatactccttacaaccctatgaaataagccaagcatatgaatatctacattatatagataaagactctgtagaccacagcagttatagtagcaaacatagtgagaggaaaaaacagaagttaattctagattttttgatacttaaaacattcacatatatttggccttaaagacagtagattttctctaccgaaatgtaacccagtttttataaatgttactgaggcatgctttttttttatttttgtggaatttgttattatttttcaacctacaataatctattcaatacccactctgccaaataccgtgctagccatgtggcgcctccaggattagaagttcctttgctgttatcagttcttatagagtgatgttgaattgtaggaatgtgagaatttggcctccttactgataagaaagactattaggaaactttccaacctgttggaggcaaatgagcgttaatgcaaaagttgacttagaaaaagctttattctaattccagcttggccatattctagttgcgtgaatttcagcaatttgctttgtctctctaagccgatttttgctttacaatggggatacaaataccaacctaacaggtgaaaagtaaatgttatataataaaagtgctctttatagtaccttcctcataggaggtacctcttgattatttttaatgaatgcattagtacacctaaatcacctgcatatatttctgaaccctctaagcggtatattgtgccttgattttttaaaaacataataataacctgtaatcctagcactttgggaggcttaggcccagctattcaggaggcttaggtgggaagagcacctgagcccagagaggttgaggctgcagtgagccatgattgcaccactgaactccggccttggtgacagagtgagaccttgtctcaaaaaataaaaatacaagtataaaataatgatgcaatccctgccttctggtagcttacatttgataaattaagctgaaaagaattgtgggtatgcaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaaaaaaaaaaaaaaaaaaaaagaattgtgggtatgaaataggaaacaagcagacaagttacatgagtcacttagaacttgagttcttcttataatatgggttcaaattacctgttgccaggtttaaggtgaatcgtttaccatactgttttattttccatggtctaaactgaaatgtatgcactaaggtcagagaaccaaatattagctttaattacacaatagatatattagagaatgccacagactttttactgttttcctacaagtctaaaccttggcccctacatgtggggataattgggtctgcaatctagttgcttgcataatcctagcttgccttacagtgtagtgagagctccaggtaaagagcacaagtgagcttcaacatttattcattttcccctcgcactggggaaactcgcaccaaggggttagagtcagattcttgccatctaacaaatcagatgaatcactcctgctcacatagggagaagcttgtgagagatagaggaagagcaacaatttctacctacagaaattattttacagcctgccattaggtgtccaaggagagagagagaaagtttcactctacacatctgaggtagaagtttgataagaattaaatgagggtgtatataaaacaccgagaaaactgccgcccctatattacctgctcagtcaaaggtaatatactctgatgtgtacacaatctacatttgcaggaagaatcctgagacccacagcaaatcagcaatgctcctcatgggagaactccaaatcataccccatctctgactcttaggacctttgataagatggttatcttatcaaagataagaaggggaagaaggggttgctgtgggctgtaggaactgtgagggcctcagagaagtcatattttgaactggtgagtcaaaccttgaggagaatgttaacataaagagcttctcctgtctccgtcaagagacataacctctccagtctccgagctaattcaggggcttgaacccatggcctttggtcaacttcgagctctaatatccagaggtggtatttgtattgggttacctgacaatgactggactaacttcctcctccgacacacaccagcaggtgactgggcctccctaaacacctcatgattcttcttccacagcctggcttttgagtaggacttattccacaactgaacagttggaattgcttctgatcatatgtgctgaactgcttagcatttatttaattctcatttcttactgtgtccttaaatctctcgattcttaactagaaaagtggaagtcaagagggagcactactttgattgtctccacccatttcaaaatgtcaggaggtaataaagggggctgtctgaaacctgaggagcttctgtactgtttctgactgagaagtagggatcagagctgagtgtcaggtatgaaattattttcagtctctggcttgctccagcctccaagttctgttcacgtcatgccttctcagactattaacagaaggaaaagctgaggttgtttttattgttctttgttttgtttttttaaaataaagtaaaaacagaatgatcagaacataacactgctgctgaatgcacaaggaaccatcttatcaaaggtcctaagagtcagggatggggtatgatttggagttctcccatgaggagcattgctgatttgctgtgggtctcaggattcttcctgcaaatgtagattgtgtaaacatcagagtattggctgccacagtcagagggaatgtaggcatttcaaagagttttcagtttatgcgtcagcaattgctgaaaactcacccttcaaagtacagatattactaatgccctgtttctgctcttaattgctaattatacaatctgtgtaaatgcaagatatgtgactcctccagctctgcaaatgtctttgcagctgcctgtacactcaaattaaagcccaatgcagctgtcctagaggtagttttatgtgattccctgaatggacaaattctattttgaatgctgttaggagtctctccctgcaccactcaaaagtcacttacattacggttgctttcttcctgttcagcatgtcttctcttcctggatgaagtgagaaattgccattttgctgttccttgctcacttaaatgtgagttacacaagcctttttaaaatttcatttcctctcaggaaatgttttaaaatatataatttatttcttttggtacccatccagaaaagtatatttagctctttttaatgcattgcctatatagaatgtgatttttttcttgagagccttatttcattgagtacaaacctccctttatatttctagcacattaatgttataaaaattagtactttcccgtaccctgaggaatccaggtgtcagcaagtgttaccaaaacttgggcatatgattaattggcttgagcccggatgacacaccctgtggtagcctaacacactcttcaagacgttcatcagttcacggagatattttaatgatcaccactgacatgggaatcttgctccgatgagtcctgtctctgttccctcatagtatcaattcaaatacataacacagcttctctcttggttttcataaaacatgccacaaactctttggaaatgtagtcgagtttattcaaggtttgtgaaggatagagactgaggaaagaatttgcattttcaaagtaccaaaaagcttaatttcagtattagatatctgtattctaaaaacgctcaccaaccacccgtctctggagtatttgcacagacactttccttccatgcagtttctaacatcacaccatcatgccatactggctactttctcttctcttcctcttcccacttctcataccctccatccagtactgcatggagaaatccaaattctttgcctcatgttaggcagatgtgtttgtctctctcagccttgattctcaagcctgcatatccaaacccatacagctacacagacgtgaaaaatgaatttctaagtagaaatagacgggattcatctttttagaggagacttgtaggtacaaagaattatttttctttcactgttatacttgcatcaactgtttgttgtgagttcttttattcattcaacaaatacagctgtcctctcattctctgtatccactgatttcgcatctttggatacaattaaccacaaattgaaaatattttaaaaccccaacaaaatagcaattacaacataaaaattatacagataataaatgatagagtacaataactatttgaatagcatttacgttgtgttagacatcatacgtaatctagagatgattaaagtatacaggagaatgtgtgcaggttatttgcaaatactataccatttcatataagggacttgagcattcctggcttttgatatccacagggatcctagaaacactctcccatggataatgagagatgattgtattcttttaatgcctattatgtagcaaatttcaagttagcacttgttctgggataaatttgtacctgttaataggagacagtataaacatagtagaaggaagccttagacacagaggaacttgattctagttctgattgattcatgctttcactttttctttccaaaaatggttgatgtaacctactctgtttcagcaagatattagatacagggaatgctgaaattatttagagcccctactctcaaacattgtagaatagagtaggaaagacagatgtatatgctggaccgtaaactgagcaatctgacctttatacaaatcaaggttgaatgtgtctttttttttcagagcctgtgtttacttttgactagcgaagagctttcagaaaattaatgttttctcaaatgaaatcgattggcagaaatcagagggatagaggaaatttattcaatgcagagttgacttaaactgcggtgaatgtttactttctggggtcaaaaatgcatgtaccggtttcttttttgttaacatttaatatttcctgttattaataaggaaatgttgcacctgaagtaaattaaatcaagatggaatgtataatttctttgaaaacaataaaattgttattgcagatgttattaaactattagtcaatgtaattttgtcaggattatgtactattgattaggaaataacctgatgaatcatttggaaggatgctttttatttttagctttgactaacaggagtgtttgacagaagcaagttaaaatagtgtgttatactgctacagctatgtgaatttacattaaatgctttatttcagtattttagtatttgctgttaataaagaaaattaggaatctgaactcattttagttggcctttgaacactttgagtttatgagtttgaaaacaacttcaaattaaagatacattgtgatttcactggggaactttgggtctttaaaaattcatctgatggagcatggtgcagttaggccaagtttgcaaagacatatgaatctggatcatatggaccaaaacatttgcttctcaagtaaaatctagctagtcccttttttccatgttacatatgtctgaatttaaattccctatgtcttccatctcgaagataccaggttgttttttttttagctctgaattgtttccacccattatctttttaaagaattcttcgattgtatttcccttttattataaaagcactgttttataacttttacataccaatctgtctccagtaccaatactacctcttttatgaacaacctttgtttagctgtcttattcacatatgtacctatgtgcctttgcatattttcaactctcaataaatgctttttgaatagaattcccatagctaattaaaagtgtcagctgttaaaatggacttcacacttctttctcttgaggtgaacaatgcacactggggtctgagaaggtggtttcttaatctcttactcttagcaggatacccaccttttcttaagtgcattctaagtttctggagatatataggattgcagtccagaagctgtgctgtaactaccaattctccttagatttgagtgaggttaacagagtaaaaacatgatgttttgtgaatgcgccttctgtatatatggcacctttctttatcttcagataggatcagtgttagtagatatgggttttctgtgaagataattaaaagccatataatttcacaggtatatatttggagaggttttaaagaccacatgtccaaatatataagcttttgtttccacaaagtctggatccactccttgtgattagccccattttacagttgagagacattaaaagattatgactgatccagaattccagagcaatatattgagaaaagtagaaatagtaccctgattgacgcttcttagtttctaggagagagaaaattacatgaaccctttacaaaaagaagacagaagataaaattcagaatttatatcaaattatttggctctgagtcaaatttcatctgcaagaatattatgttccaggtgtttgccattgggacaatttaatgtgtttaattagaaaatatattttaaaatattactaggtcgctcagctgtcaaaattatgtaaataaaatggtaagtgaaaataattataaaaatatttaaatgtccttatatggctttttaggaaatgtgcttcattttctttctacacaacccaaatgtccaacagtgatagactggattaagaaaatgtggcacatatacaccatggaatactatgcagccataaaaaatgatgagttcatgtcctttgtagggacatggataaagttggaaaccatcattctcagcaaactatcacaaggacaaaaaaccaaacaccgcatgttctcactcataggtgggaactgaacaatgagaacacgtggacacaggaaggggaatatcacacactggggactgttgtggggttggggaagggaggagggatagcattgggagatatacctaatgctaaatgatgagttgatgggtgcagcacaccaacatggcacatgtatacatatgtaacaaacctgcatgttgtgcacatgtaccctaaaacttaaaagtataataataataaaaaaatacatttttcctgggttcttcgggaatgtgattgttatagttacaaatgtatgcatatttttaaagaaaataaggttgagtttcagcctaggcaaactgctgaacccaaaaatcactgtgagaattttgattagtattctgtagatggttttcagtctatttttgatattttagcttagacttttgaagacagttgagaaagcattttttaacaacgagaaattcattattcctaaattaaaagataaagagtggagagtagatgtatggttgacattttacaaatcaaatactttagagttaataatttctacctgacactctatgtaacacagcattcagttgatggtaatttgttatgtttactgatcactattaagctattaaatgtttttaaaattaattattttattattttctgccatgctaattgcttaaagaagaagagcagtgattggagtggtgaaataaaacaaaataaaacacagacagtttattgtcataatatttctaaattggaagtaagtatagccgaatgcctcttatacaaggagtcagaagatctgcagttgttttcacatttaaaaacctcagcatccttgcacaaatcacgttgcttttctgacttttcaattcttcatctataagaataaatatatattactcttaccttatcttcatagcttttgttaatatcaaatgagtaatggaaatgaataacctatacaattgtaaattaataatgatgtggttgaagacgattcaaggaaattttaacagtctgtgtagtgatccaaatttggctattctaaacaattttctaatatttaaattgtaagccatgcacatttcatgatttaaatatcaatcatatgtccacttactcagctaatatttatttagcacttactgtggaccaggcaccatgcaaagctttaggggctccatggcccacctacaccgcacatgatcatcttctagtggaaagagctggagagtaacatgtgtgactctcatattatctattttgctagaaaagagtatgaacatatatgtatacttttatatcttattgtaatatcctctaactgaaaaatttatccagtagtttcttctctattttgtatacaggtctttggcctcacatatgtaggacatggccccaggagtttaataatcactcaactgagtatgttaattaggaattaagtaattgtattaacaattttttgattgaaactagattgagagcaaaaattatataactatgtgagatcaccaaacacccagagaagtcctgggaataacagtagttcagtaaatgtggaatttgcattttaaaaaggaaacttgtctgaggcaggcggatcacctaaggttgggagttggggaccagcctgaccaacatggggaaaccctgtctctactaaaaatacaaaattagcgaggcatggtggcgcatgcctgtaatcccaggtactcaggaggctgtggcaggagaatcgcttcaatgcaggaggtggaggttgcagtgagccaagattgcaccattgcactccagcctgggcaacaagagcaaaactccgtctcaaaaaaaataaaataaactaaataaaaaggaaacttgtttatataatgaagtacttagaccctgttatttttgccctgatatattttacttaaaggaactttctaaatatatacgtgtgtgtgtgtgtatatatatatatatgtatattatatatattgtatatatatgtatattatatatattgtatatataatgtatattatatatattatatatatatgtatattatatatattgtatatatatgtatattatatatattgtatatatgtatatgtatatatgtatgtgtatatatatacacatatacacatatatgtgtatgtatatatatgtgtgtatatacgtatatatacatatatacaatttttgtatatatacatatatacacatatatatgtgtatgtgtatatatatacacatatatgtgtgtgtatatacacatatatatgtgtgtgtatatatatacacatatatatgtgcgtgtatatatatacacatatatatgtgtgtatatatatatatctcccttttcaaccatattccactatctccaaacagtatgtttaatatagtcacttgttctatcgagatccccactgttttcttgttacagcaatgtacataactctatgtgatatggagcacagaaatttataatgcttgttttcagtaaaagtggagaaagaagccattttagggtatacatagcactaatcacaatgcctaaataacttcataataaataacatataaagaagaatgaaaaggtagaagaaaagaaggaagtgagggaggaagggagggaaagagagaaaggcaaactacagtggtgtgtacagaggttcattaaatgatagaaaggtaaacagtgctccctactaaatcttttcattctagtctcccaaaatattagtgtggcatcagccaatttcatgtctaaaaaactgtctcagtttattactaatcacaccaagaagcaagtgtgttaataatttataatctatcatcgagacaagcttttactgtttctaaattatttaaaatgatctgttttctttgtctgcctgtttatttaatcaatttaattcttatatattgttctatttaaaacttcactagttgacatttagtcatttgctgtcccaagtttgagttgaaggatggaatttttaatgagatcctttcaatcattcaacaaatatttttatcacctatacttctggatacttagcatatagcagtggaataaaacggaggaaaaaaaaaactattattgtcctcattgaagttatttactagtaggagaagtgatatggtttggatctgtgtcactgtgcaaatctcatgtcaaattgtaatacccagtgttggaggtggggcccggtgggggtgattaaataatgggggtggattttgcccttggtgctgttctagtgatagtgagtgagttcttatgagatctggtcatttaaaagtgtgttgcagcttccccctcgtctctctttctcctgctccagtcacgcgaagtggctcactccctttatgccttctaccatgactggaagcttcttgaggcctccccagaatcagaagccacaatgcttcctgtacaacctgcagaaccatgagccaattaaacctcttttctttataaatgacccagtctcaagaatgtctttatagcagtgcaagaatggactaatacagggagatgtacccaacggatgaacgagtgaaatatttaaaatgtcagaagaaaataaatactatgcatacagatgaacaaagtaaggaagatagcctgtgacaatggagtgattttattttaagtagggtggccaaaggacgcttatttgatttaatatttgagtagtgacttgacgaaagtgacaaactgacacatgcaaatatctaaggtaaaaggttacaggtggaggacacaacaatgactaaggctccaaggtgaaaatgtacttggaatattgaggtaagtcaaggagtccagtccagctggagctcagtaagcaaaaaggaaaaggtaggaggtaaagtcaggaagtcagaaaaaaaattatatatatataggttattataaagacattgtcttctactgaatgaaagtggaagccattgaagggtttggaatataggaatgatagaatctgacaggatctgacttttgttttcagagacaaggtctcactgtgtttcccaggctggaatgaagtggtgtgatcataggtcactgtaatcttgaactcctgggctcaagccattctcctgccttggtatcccaaagctctgggattataggtatgagtcaccatgcctggccagatcttactttttaatgtaatgattctgggatttcattcaagatagactaaagggtggtaaagactgaagtaaggagactagtgaagaggctatagcaagacatggtggtgacttacaccagtatcataactgcagaagtaatgagaagaatttcctaacactcattcttgtatatgagacacacacaatgtctcgaagatgacttaaagagttttgccttgaggaaatgaaaaaatgtagttgccatttaataaaatatgtaaaatttcaggaggaataattttctggcattttggaatggaaatcaggagttggtagcagtcatgctaatgtttggatgtttacaatttcataatgtagtctctattaaccttacaagtcctgtggtattgaacataaatttctattatcctttagaagcttcaaagcactaatattttataaccattaaatttttacttgaaacattttggatcaaatttcttattgtttttgtttttctacttttcacatagaactcaaaaaatggacttttaaccttggtagtaatcagagggagtcttgaatttgaagtgatgctaaacacccacacttcatttgcatttatttactgcctttatttttgcaatttttaatttcataaagtgtctcaggacttcctataaaggtgtacgtataaaaatagtctcatataatcacaccttgcagagataactattgttttcattcatattctttcttatcactccataatccattcacaactcacacttgtgtatttattgtgagaatgttatataccaggaactgtactaaatgctttacacggattggctagtttaagtcatacaacagccttttatcagtcatgttattacttgcagataatgaaaacaaaccacgtagtttacacattaaaaaaagtattaaagaatatcaacttaaagatttcccagaaattgcaaatcatgctgaggtgctgtacagatggacaatgtccaagactgcaggacatatttggtctgatagaaaggtcacaattgcttctgcgattcacagacaatgcatgtgacaccaccaattctcctagcactggacactggatattacctctgaaatgtttgcatctgctttccatggacacctatacatgataaattttcttacaatagagtaagtgtgttcaaattctgggaaaccaaaaatactactggaatggtccacgtcttagactgcccaataccagtgtattaatatgtactcagtaatagagactcagataataaaaccaacccctgataagcaggcaaataggaaagcaagactaatttattgtctctgcaaaagagggtcatccaaatagttattatttttatgttgagctgcagctctcatcagcaggtgattgtgattcttctataatttcattacaatttacctcaagggactaaattgggaaggtcaccaccatcaatgaactcctttttaaaaaattactagggaaaagagagaggagaaacacacaaacacacacacacaatagttagcatagccaatcatatacaagaccctgcacagcatccatgctggcaagggtggtggcagttacctccagtattcaaaagcatcaaaaatacatagttattaggttattaaacagaaataccaaaatttatgataagcactgccgaggagtgggttatatttctagctctgaaatctaggatccatctcttacgtgttctgtgtgctggggaaagttgcttaacctcactagccttcagtttcttcatctctaaaatagagacatcaataatatacctatctgatagaactattattgtaataatatgaaataatgcatgtgtcttctattcaaatgtaacttgtttgtgaattaaattacactatgggtacatctgattatctgactggccctgaagaggaccatgtttggctgctcttgcgagtaaatcagtaactcaacagtggcagtagccaaatgagtgataatgaggtgaagtttcaacagcagaggttgcaatactttacgtgttgtatataactcaggattctttcagcaaaagaattgttatgactataaaaactaagaaaacaaatttaaaaatagttttctagtggaaaaatgcaaagatatactttatatctgttttgtttttgtagcatatataatagagaagtagtgtgggaaaggtcacacattgatacagcagaagcattggaataataattatgtctagcaattagcaaacatctatcatagttcagatactatactaagcactttacatatataatttcgtgtaatcaacatagcaatttttgaaaattgtggaattgaatattagagaatataagtaccttgccctaaagtacacaatttaaaatggccatctaacttctatattatcgtggtaaatcaggcacttaatgatcagatatgtaatatctactttctgccatagtgcattcctataaactgcaagacaaagcaaataattgtaaaatgaatggtattttcacaaagaaacaatgccattattgaaaattgtgttcttaaccaataatatgacattgaagacatcatgtatatataatcaagaatatgtcataagaacaaagaaaccgtgaccataaaatgtgctaaatctgatagatattaattaattatgtatttgatgagtaataatgctgcttctcttttttgaacttaggatcttgaggaatattttcagtggcttttatctctaagaaaactctcaagtggggaaaaaaagcaacttcaaagctttcttctttcttgataaatgtcctttacttttgtagtcatttagaactactccactgactatctttttaagttgctatgatagcatctaatattggggaaaaaaagaaaaaaaaaagctttgaatgtagtaatgtagaagacctaatttctaggttcgtctctgctggaaattacctacaacgcccaagcagtagtgcttcttttctgttcctgactttctccatttctacgaagacactagatttggtgaactctaaaggctctttcagggatagaactttctagaaactggtatagagtacccagtccttggatactgatctaagttgttggagagcagacgttttctcagtctggttctgttgactattgattcttatttgtctgttcttaccacaggatcaaatcatgaagggaatctcttccaggttatatgacttgctttggtcataactagtgtttacagacacatagtatgatatgtcatagtaaaataagaaggaatctagaagttttgaattcaaatcctgtttcttcatttactgagtgaccttcaactaagtcacttaacctccttaaacctagaatttcccattaataaaacagaggggatagttcttttcctacagggtaatgataaaaattatgtaaataatgtatgaaaacatcttgtgtgtatctatctccttatgatagttataggctgatgtagaaagtcaaacccacgggcatcttgataatttgttagaaagccactccctaatgggacaatgtgcctagacaaaagagtttggaagtaaggtagagatgctaattagctgtcaactgattttgaactgatcaacataacaaagcttaaatagactctattgctattatcagtgcctgttaattcactcagagtatgtgagcaaactataaacctgcaaaggattacagaggatgcttagcgcagtgaagccctgtactgaatgaacaaataagcccccagggaagcttttaaaaattaccagtttctagagccggtccctggacattatgattcaatagatgaagtgtggtggctaggagtttgcatgttaaagaatcttcgtagaatatcaatgaacagccaagattgagaacacctgaactgatcagattcctcattttacaagtgaggagtatctggcagagggaggaagattgagatcccaaagcaggaacttgaaaaaaagttctcctgatacttaatcctttgttctttccataatatcacatggcaaaagacagatagtagagtcagtggtatttcctgcaagccaggaccattgtatatggtatcctggctgtctatgctgaagtcaggtttatgttctcatgcacataatgtgagccatggagtgctggggccatttgtcagagacaaccttctacaatgtcacattaccaggttgtcaatagtgtacactcacctgaggtaggctgccacattaaaatgggacacaatgacaggggagaatctagatgtaaaattgaaagagtcagaaactgcccacagtcagaggaagaaataagaagtggaagcctggaggcattttctgatattgccttggtgtttgattgtgattctgtttctaggcatagcaaaaggaaacaagactgacttgatggtcaaggtgatgtaagtagatcagctggcttccccaatttttttgaaaccaaaaaagtaggcccggcacggtggctcacgcctgtaatcccagcactttgggaggctgaggcgggcggatcacaaggtcagtagtttgagaccagcctggtcaacatgatgaagccccgtctctactaaaaatgcaaaaaattagctgggcgtggtggcgtgcacctgtagtcccagctactcaggaggctgaggcagaagaattgcttgaacccgggaggcggaggtttcagtgaaccaagatcgagccactgctctccagcctgggcaacagagctagacttcgtctcaaaaaaaaaaaaaaaaaaaaaaaccaaaaaagtaataggtttatatgtatagtaactaacatattataaagttcattaccagaaagtttatatcttggtcaaatatatttacctaaaaagtggaatatgaatattaagatacagtattaataaagtcattaaaactcatgatttgagagaaactagatctgtagttagaggcaacaacagtttattgcatggaaaaatctttccaatttttagttctggttaaaatccttctggggtagcggctttttgtttctaactttaaaaagttcccatacacaatcaattgtactattttattcattttgaaatgtttgacagtggaaggactgggaattgaaagactttgattgcaatcctgacttgccgtggaccaatgtcatgaccttgcagaagttccttttccctagactggtccccattgtactcactggaaagacatgatctcaaagggctcttcaactctaagagtcagtaagagcaaaggtttgggcagagatgaaaataagatagcagggtgcatctgggaggtggaggatggaattgaatctgatcccaatgcatctgtggggatcagagctaaaatcaataatgtatgctgttgtttctttttatctttttttcttttttttctcctaatgtctttccccatcttttcctgcctttttaatattatgtctcctaactctagctttaactcctgaattatattaggattttgttaaagttcatacattttaagcaaagagatgtagaaaattgttaaggcttaaaatgaatttcaacactcagtaattgcatatcctctgcttcctactggaagagaaagaaacttttcgtggactggagggcaggagaatgagaaaaaatgtgttttcttcaaatttctatgaaaatgtgacagcattcatagggagacaaaaaaaataaattagaaaacctgataatccttctggagcagtgctttttctttcatgaaaggcattgtgaatcttcacccatagaaacattttgagcacaattgaatgcatttgtaatttttgaatcctatatttgaaaaacatttgaaagccaaagtactaaaatctaaagaaaatgcttttctatcggcctcctatcatatttttatactgtgatagttacataacttgaaacatggtgtttttaatgtagtattctcaagcaattgtttagggaacaaagactcaccgtatggtacactggaaaatacagcagaaattttgaaatcagaacaaactggactgcaatctccctcccacttcataggtataacaattttggaaaatcactaagctcctagttttcttacttgcttctcgtgaaggtagagtgtaatatttgtacaagctctttatgaacaatacaggttacaagagaaagggaatgtgttgccagccaatcagctcctcaaatgtgctttcattgggtggcaacatctctaatgtgaaattgatattatctatatgtgattactaagatcatgacggaggtgattcttttgaagtatcctcagtgcagggtttggcacagactagttactcaatacatatattctagccttttctttttttgcttacacaacgttaacttatgggtataatagtttaattatcacatgatcacacttgagttgttattcagaataattttgtcctcagcaaataatcagaacattaataggcaatgcagatagagagtttatgagtgaatgacagcaactggcccaacttcttcagcactaggtttctaataattcaagcctgcagattgtgctgtatttttattcatttgcactgcaaagttttttttttctgttaaatccttgttatttggccctgcatcatttcagtaaaataaacttggctccatcaaattcattaggcaagctatgatgtgggaaaagtcaaaatttatcttccctgaagctactttcagacagtaccttaagctgggcattttaaagtggtgtcagataaacttggcagccgtttctttccacagatattcttagttgaagcttttggtctcttcttcactcatgggatggttcctcttgccctggttgcagaatagcgttcgagcagtgaggattctcagcttttctgttttacagccctagagacttggctgctgcagctgggtatcaagcaatgattttcacatgcctttttcatcactttttttctaggagaagattgcttttgacattcatttttaagttacatgtcgttttccaagagtatatctctcacaaaagctttagaatgccagtaataaatgtattagtagctaagaagctcagtctggcaactaccttgtctgctttaagtcagtgtgaaatacttccaataatttaactcttcttaaacaatcacttgatgtaatatttaaatctaaacattaaaatcttctgtggtttttgatctgtattagttcagtactacatagattaaatatttgatatctgtacctgaatttgatctatactcagccagcaggagaaatcgaagggagcattagatactcgtttatttatttattttaatttattctgaaaaatgattaacttacttatttgtcagaattgattgtttaaatgaattgacttgattgtactcattttttggtgttcggttagaataccctcaattgacagagtcactggtccagcagcttacaagtataatcaaaatggctatcttatgtagaaaaggcagtaaaggaatgatattcactgggaggccccttgtgtaggtcaggaactatgttaattattacatcttatttcatttaattcttgcaatgatcttaaaaggtaaatattatcctaattttcaaaggaagcattggaagcagagagtatgagtaacttctgcaacactctagagtcaggattcatacttaagtcagactccagtctacaggaatgggccacaacaccaagctcctcaatgacttgttttgctcttgtcctatcttttgtgcacttacatctttatcactatgttcaaaactaaaatacaattttagtgcttattttatccagttttattttttcaggttaataccagccacagagcaatttagattccccatctccctttgaaaaatatacaattcaataaccatacatgtgcatgtgtctttataatagaatgatttatattcatttgggtatatacccagtaatgggattgcagagtcaaatggtatttctgggtctagatccttgaggaatcgtcatactgttttccacaatggttgaactaatttacactcccaccaacagtgtaaaagtgttcctatttctccattgcctcaccagcatctattgtttcctgacttttgaataatcaccattctgactggcatgagatggtatctcattgtggttttgatttgcattcctctgatcatcagtgatgatgagctttttttcatatgtttgttggctgcataaatgtgttcttctgagaagtgtctgttcatatcctttattcactttttgatgggtttttttttcttgtaaatatgtttaagttccttgtaaattctggatattagacctttgtcagatgggtagattgcaaaaatgttctcccattctgcaggttgcctgttcactccgatgacagtttattttgctgagcagaagctctttagtttaattagattccatttgtcaattttggcttttgttgcaattgcttttggcatttttgtcatgaagtctttgcccgcatctatgtcctgaatggtattgccaagcttttcttctagggtttttatggtttggggttttacattgaagtctttaatttatcttgagttaatttttgtataaggtgtaaggaaggggtttattgcagcactatttacaatagcaaagacatggaaccaacccaaatgcccatcagtgatagattgaataaataaaatgtggtacatatacaccatggaatactatgcatccataaaaaggaatgagatcatgtttttcctgggatgtggatgaagttggaagccatcatccttagcaaactaacacagaaacagaaaaccaaacactgcatgttctcactcataaatgggagttgaacatttagaacatatggacacagagaggggaacaacacacaccaggacctgttggagtgtggagggtgaggggagggaacttagaggatggatcaataggtgcagcaaccatcatggcacacatatatctatataacaaaactgcatgttctgcatgcatatcccatttttttagaagaaatgaagaaaaaataaaataaaaagactttaactcagcttcgtatcctcaaaaaagagaaaaatatgcaattcaaatttccctatgtacaaactaaattcttaaaaaagttaaaattttgtcttaaattacaaattataaatgtaaatcttaaattataaattcttaaaaatacatgtcccccgtagtgagaaagagctgcagttaaaacagtggttagcaattcccagtctagtagtctaacaaatagataccttgtacattcagtgttttattttgcttttcattgtgttaaataatttttactaatattcacagatttcaaatgaggacaatttaaaaatataattagctcagagcagaattccacaaaattagtccttcatgcttgaactgagtgacctgttcatgtactaacaaatatttcagtgtccatctctgaagggcaagatttcaagtctcaaagcttctcacattgcatgtactgagaaactatactcctatgtgattgtcataaaactgaatcctaccaatgaagacgaaatgataagaaattcataagtcctcctcagagacagaaagtacattcccacccttatcacctcccataattgttaaggatgacaattattatagttatatttattgaactcatactatgtgccagtaattgtgctaggtgctttatatacaccctactggctgcctttttaggaggtattagtaaccttatattctttgattcagtaatttcaaatgcggaggcttacaacatttgtcattcaaaaaaaatcactcactgactctaaagtccatgtttttgtcaccatgttgtagctgctccatttaaataaaggtgaaaggagttgagagatgtgtctgctatgtacagcatctgagattaaagaaaagaaaacaacagaacaactaagaagtgtccttacattttttttattcagaatcagaatcaatcagtgatggtttgtaaacatctacagatatgttttgcttcttttgttattacttagggtgttgagagttacagtttatagtatcatgtctttttttttaaagaaaaaaacaattctgtctttggaaaaaaaaaatggaaacctacttatagtttaaaagggtcatttatatcaaagcacatagagccagttcctgagaattttcactgattttgtgtatgacttcccagaaaagccttgtccattccaataggtgacataagaaaaagtgatattctgacattttctatttgctatagatacatgattattaaaataaattcatattgtattcaatttttaaataatttggtaatgtcatttaatgtcagttagttaaatcatataagcttatttgtaactgttccttatattttagaaatgttaatccattattatttgttctttttacttttgagggttttatttaacttttaagttcaggggtacaagtgcaggtttgttacataagtaaacttacgtcatggggggttattgtgcagattatttcatcactcaagtatgaagcctagtacccattagttatttttcctgattctctccctcctgccaccttccaccctccgataggcccgagtgtgtgttgttcctccctatgtgtccatgtattctcattttttcactcccacttataaatgagaacatgcagtatttggttgtctgttcctgcattcgtttgctaaagataatggcccctaactccatccatgttcctgcaaaggacatgatctcattccttttattggctgcatagtattccatggtctatatgtaccacattttatttatccaggctatcattgataggcatttaggttgtttccatgtctttgctcttgtgaataatgctgcaatgaacgtacacatgcatgtgtctttttaatagaataatttatactcctttgagtatatgcccagaaataggattgctgggatgaatgacatttccatctttaagtctttgaagaatcaccacactgtcttccacaatggttgaactaatttacattcccaccaacagtgtataagcattcccttttctctacagtctcaccagcatctgttattttttgaatttttaataatagccattctgactggtttgagatgatgtctcatggtggttttgatttgcatctctccaatgatcagtgatgttgaacttcttttcataggattgtgtgggtcacatgtatgtcttcttttgagaagtgtctgttcatgtccatcacccactttttaatgaggtgggtttttttttcttgtaaatttattaactttcttatagattcaggatattagacctttgctagacgaatagtttgcagatattttctcccattctgtaggttgtcgggttactctattgacagtatccttggctgtggagaagctcttaattttaattagattccatttgtcaatttttgcttttgttgcaataggttttggcatcttcctcatgaaatctttgcccatgcctatatcctgaatgatattgcctaagttgtcttccagggttttttttatagttttgggttttacatttcagtctttaatccatcttgaattaatttttgtataaggtgtaagaaaggggtccagttttagtcttctgcatacacacaatcctttccccattgcttgtttttgtcaagtttgtcaaagatcagatagctgtgggtgtgtggtcttatttctgggttctctattctgttcctttgatctatttgcctgtttttgtacaagtattgtgctgttttggttactgtagctctgtagtgttgtttgaagttgggtagtgtgatgcctccagctttgttttttttgtgtgtgtgtatgtgtgtgtgtgtgtgtgtgtgtgtgtgtgtgttttgcttaggacttctttggctattcaggctccttttcagttccatatgaaatttaaaatagttttctccagttctgtgaagaatatgaatggctgtttaacaagaatgtcattaaatctataaattgctttggatggtatggtcattttaatgatattgattcctcctatctatgagcatggaatatttttccatttgttcgtgtcatttatgatttatttgagcagtgttttgtagttctccttttagagatctttcacctccttagttagctgtattcctaggtattttattctttttgtggcagttgtcaatgtgagttcatacctgacttggctttcagcttgactgttgttagtatacaggaatgctcatggtttttgcacattgatttgtgcatactgagactttgctgaagttgtttatcagcttaagaagtggttgagctgagactacagcattttctacagatagtatcatgtcatttacaaacagtaagagtttgactttctctctttctatttagatgccttttatttctttctcttgcctaattgccctggccagaacttccaatactatgttgaataggagtggtgagaaagggcatccttgtcttttgctggttttcaaggggaacgatttcagcttttgccaattcagtatgatgttggctatgggtttgccatatatggctcttattattttgtggtatgttctttcaataactagtttattgagactttttaacatgaatagatgttgaattttttcaaaagccttttctgcatctattgagctaatcttgtggtttttgtctttagttctgttcatgtgatgaatcacatgtattgattttcatatgatgaaccaaccttgcatcctggcgataaagcctacttgatcgtggtggataagcttttctgatgtgctgctggattctacttgccagtattttgctgaggattttgcattcatgttcatcaaagatatgggcctgaagttttcttttttgttgtatctctggcaggttttggaatcatgatgttgctggtctcatacaatgagttagggaggagtttcttctcaaatttttggaattgtctcagcagaaatggctccagctcttcttggtacagctggtaaagttcagatttcaattcctctgatcctgggcttttttgggttggtagactacttattactgtctcaatttcagaacttgttattgatctgttcagagattcaatttcttcctggttcaatcttgaaagggtgttatttgtccaggaatttatccatttcttccagttttttttttttttttagtttataagtatagaggtgttcataatatcctctggtggttgtttgtatttccgtgaggtcagtggtaatatcccttttgtcatttctgattgtatttgaaccttctttttttttctttatttgtctagctagttatctatctatttcattaattttttttttcaaaaaacaagctcctggattcactgatgttttgaatagttttttgcatctctatctccttcagttcagctctgattttggttacttttttgtcttctgctagctttgggttttgtttgctcttgcttctctagttcttttagttgtgatgttaggttgtttgagatccttttacattttgatgtggacatttaatgctataaatttccctgttaacaccgccttagctgtgtcccagagattctggtatttttttttctttgttctgattgataaattacaaagaacttcttgatttctgccttaatttcattatttcccccaaagtcattcaggagtaggttgttcaatttccatgtaattgtgtggttttgagtgaatttcttagtcttgatttctaatttgattgtgctgtggtctgagagagtagttgttatgattttagttcttttgcatttgctaaggaatgttttgcttctgattatgtgattggtattagagtaagtgccatgtggtgatgagaagaatgaatgtgatatggtttggctgtgtccccatccaaatctcatcttgaattgtagttcccataatctccatgtgtcatgggagggacctagtaggaggtaattgaatcattggggtggttacccccatgctgctcttcttgtgatagtgagtaagttctcacgagatctcatggttttataaggggcttttcctccttttgctcaatgcttctccttgctgcaatgtgaagaaggacatgtttgcttccatttccatcatgattgtaagtttcctgaggcctcctcagccatgctgaactgtgagtcaattaaacctctttcctttttgaattacccagtttcaggtaattctttatagcagcatgaaaccagactaataaaaaatgttatgttgtttcttggtggggcgttccatagataaatatcaagtccatttgatacagggctgagtacagattctgaatatattttgttaattttctgcctcgatgatgtgtctagtattgtcagtggggtgttaaaatctctcactattattgtgtggaagtctaagtctctttgaaggtctctatgaatctgagtgcttctatgttgggtgcatatatatttaggatacttagatcttcatgttgaattgaaacctttaccattgtgtaatgcccttctttgtctttttttatctttattggttttatgtctgttttgttagaaactaggctagcaacttctgttttttttttctgtttttcctgtccttggaaagactggaattttcctccattttttattttgaacctatgtgtgtcttagcatgtgagatgggtctcttgaagacagcatggcaatggatcttggttctttatctagtttgtcattctgtgtcttttaattgggtcatttagcccatttacatttagtattattgttgtcatttgtggattagatcctgtcatcatgatgttagctggttattttgcagacttgtttatgtggttgcttcatagtgtcacttgtctgtgtacttcagtgtgcttttgtagtggctggtaatggtctttcctttcatatttagtgatttcttcaggagctcttgtaaggcagttctggtggtaacaaatttcttcagcatttgcttgcctgaaaaggatcttatttctcctttgattacgaaacttagtttggccagatataaaattctgggttggagattctttctttaagagcattgaattttagcgcccgattccttctggtttatagagcttcagcttagaggtccgctgttagtctgatgtacttccctttgtagatgacatggcctttctgtctggctgcctttaacattttttctttcattttgaccttggagaaccatgtggttatgtgtcttggtgatgatcttttcatagagtatcttactggggttctctgcattgcctgaatttgaatgctgtcccctctagctaggttgggggaaggtttcatggatgatattctgaaatatgttttctaagttggttccattctccccatctatttcaggtacaccagtcatatattcaatttcattacataatctcatatttctcagaggttttgttcattcattttcactattttttctttattcttgtgtgtctgtcttatttcagaaaggaagtcttgagctctgagattcattcttttgctttgtctattctgctattactacttgtggttgcactgtgaaattcttgtagtgtgtttttcagccctatccagtcaattacattcttctctatactggctattttgtctgttggcttctgcaatgtttctttttttattatttgaatgaatatttatttaaagtttccaaaatattaccaagacactgtgctaagctgaaggtggaatatgcaatataaaagcagacatagtccctgtcctcagggagcttaccatctcattggggaaacaatcagtagacaaataaagaaaaataaaattagtgtcttaatagatagcaaagtcaattctttaggaagaaatcatattcttctttaactttctttgtaatgagatatttatttagttatttatttaaattccaatagttttgaaggaacaggtggtgtttcagaaaggtagtgtttaagttctgagtttctttcctccactttgtcttttctgctattactacttgtgattgcattatgaaattcttgtagtgtgtttttcagctctatcaatcaggtcagttacatttttctctatcctgactattttgtctatcagctccagtaatattttatcatgatttttgtcttccttgcattgggttacaatgtactgctttaactcagtaaccttcattcctctccacattctgaattctacttctgtcatttcagccatctcagcctcagcatgttgtaaacacattctttaatccattatcccatgtaactgtaatatttgtttatggttgttagtgtttgttcatgagttttgcaatttgcattgcttaaattctttctatgcagtcaaaactaggtatctctttctgtattaaatttgacttaggtattaggcttaaaatccatttcccatccatttaaaaataaaaccattcatgaatatattctccttgtactttaatggtttaacatttaaattaaatttaataacttttcatcagattataaaaattgatatgtaatcattgtgaaaaattcaaacaacacagaaaattgtaataaagaaagtaaaaggagccaaaaatagtagcattaaaaatttttgatatgttgaaaatgtcttttcagatgtatccttagtcatatatacaccatgtctgaggatgcaggtgtgtgtgttgttctaaatgctctatgcacactgctattgacactccaaaatatgtcgtggtgcctttttatgtcaattaatacaaatatttttcattaccaccaacggttacatggtgcaccattttatggacttgttacaatacatttcattaaccatctgtttccagttttttattatttagacagttatttgataagatcatttgtttgcatatgtgtgtgcatgtatacctcacccaattgtcaggttaatccatttttatatatttctagactttgaatttttgacctaaaaagattgcaatttaaaatggttttacgtatatttctaaaagattgctataaatattgagaaatgtttacttctaacatctgcttaatctttacaaatttgatacttaaaaacttatacatctcattaaaaatatatctgaatgtcagagaagttagcacacatacacccaagtataacattttattaaatcctcaatttaattttccaagcataagaagtttttacctgaagtgaaatggcaacacaaggtaagaacagatgtagcatgttttgatgtattttttcttttggcgccatgcagttgcagttatactttctggacaaatttgcatcttgcttgatttgtgaagttccgcactttctttcccgctactcttttatactcagagctagtaattttattgtgaaagaacagagcaaagcagtgtatcctagaccatttcagggcatgtgtgcatggttttaaaactaaaattagtatcagaaaagctacattctcattcaggtggtggtaagggagggattgaataatttgaatgtgtcaatagaggatcctgatatcattaaacagtatctgcctctatctttccggtatttctagataaaaataaacaaagagagtattccatgaaaaaaaaacaacaaagatatgagaaaaatcatgaaacagtagagagaatattggtatctacgaaagttgtcatcccaacaaatatggttgtacacaaccaaatgctatggctctatgaacttcattgctgcagtggtataaaatataagccaagaagctttaagaaatgaggattagaaaagcttatgctctattttaaaagatttgactttattcaacatgtaacgggaaaccattagataattttaacccatgaagtaatacatgcatgtttgaatttcagaaaactccgatatttttgtggagactggattagagaagtactcacataaagaaaaagtagagagtgaagagtctgttgaaataacactggcaaaaattaatgtttgaatgaagaaaataaacttttaagaggcaaaattggtaggactttgtaaaagatgttataaataaagaagggaaaaagtgtcaaagattactggttcatatgctgaataggaaacatcggatttaatgcaagttttacttttatcaagaatatattataaaatggtaagttcaagagtattgaagatgtgtacaaacggtgattattatcattcaaagtcaaatttaagatagacaaggaggaaagaaaacatatcaaatacatgatagtcaaaagataaaaatatttatggtcctggtgggagcaaaggatgttggaattgtagttctagaggaactgagccagaaagataggaaatggcgatcagagggtgggttacttgccattgagattacctagcatttgcagttattggtagttattttcagatatgagtgggagtgagtggctgaagtgggatggaaggcataatcattggaagagagaaagttcaggaactgagaacccctggtgttgagataattttccatatgaatgttaaaatcgctgaggatcaagacaggaatagggactacagagcgcagagttgcacagaacatagttctgaattagcgaaaattctaatggtattaaaaactttaagaggtaatcatggtattgtttcttagagattcccagtgtgatcatacaacctatatcatcacttttaaaaatattcccagtccatagcctataataagggcaagtttacacatgcaccatataatgatatcaatccctcatcacaaacgaatggaatacagatggacacctgaccattatattctcatcagaccactcaaatactcttcactagaaactttaattggggtccagtgactgggtcagtcattagtaggaaatttagttcaagagtcatgtagagtcatgggctgaggctccaattctggggtatctctgattagtcatgtgtgtttgctgagagttaaggagaaaaggcttttctgagagagaagcaggagaatggagcagcaaacagacataaacacacacatacacacacacagaaaaattgtcttgattctaaattctcatgaggtcatgttacatttcctatcactaaattctgtaaattctcatgtatccttaccatacttctaatatttagctatgctattttgatgggattcctcctccatgcaatcagatttgctttatgagagcagctataatttactcattcattcaataagcattaaatgagcacttactaagggcctggactgttggaagcactatggaagataaaaacacgagcaaaatatggtttctgtcagtcagaaaattaatagtggagaaaacaaatataaaatataattaaaacacaatgtaatgagtgctaaactagagatgagcggtaaatattatgatctcattaggcaaaaatacaatatgttagctaatctgaaagatctggtagagtcagaaaaagccggtagagtcaggtcaaatgagacaaaatttaaaagtgtcttgagcaataagcacatatttgcaaagtgaagatgtttgaatgtctagatggagaagtgaaggtaacttagaacaagagctttgaataattccaagattcaagggtgtgttagtctgttttgccttggccataaagactattactggagactgggcaatttataaagagaaaagttttttttggctcaagattctgcaggctgtaggagcgtgacaccagcatctacttctggtgaagcctcaggaaacttataaccgtgaagaaaggcaaagggagagtaggcatgtcacatgatgaaaaaagagcaagagagagatgggggaggtctcagactctttttaacaagtatatctcacattcactcattacttcaggagggcgccaagccatttgccagggatcttcccccatggcatgacccaaattcctcccattagtccccacctcagacatttcaagatgggatttggaggggacaaacgtccaaactatattagagggttaggtagattggataagttagcaaaggaaatgtgaaagaaaaggcaaagggaagaaactaggggactgtgatgtcatacaaactcagggcaaagagtatttcaaggaggtagatgtcaattacattggacattactgtgacattaagaaatacaatttttgaaggtttacattacattggtgatactggtttccttagctggaggaagtaaacttagttggagaagtttcagtacagcagtgagagcaaaatctggttgaaacaccttagtagtatgtgggaagtaagggattggagagagttaatatggacaattaattttttaaaatggctttgaaggtcaacagagcagtagccgaagagagaagtaaaatcacaggataatttttttaaagatgtaaatatttgagtgcattaaaatggagctaaagattctatcatatgtcagtgggtagagaaagaataattaaatgatcttgtgacaattagtaaaaggttatagaaatagtaatgaaatgatgttgtgacaattagcaaaaggttatgcacagagatgttaagcttggctttatttacaacagcccagaaagaaatgagccttaatgtcacaaaatgtcccaaaataaatgacgaaaatcttgaagatttttcataggatttgggtaggttattatgaagaatttaaaaataatatttcacagtaacattaatgagaaaaattatagtggccaaaaattaatcaagtgaaaaataaaaagtacagtgtaatatataaagcatattaactatgattcttattttgccattcacatacgcacaaacactggacaaagactggaataaaagaaaagaaattgttaagcagctatctgggtagtaagattactggtgattttactttaaaaaaactcaacttttaactttcaataataagcatgtattatttttataatcagaaagaaacaagtattgttctatactagatgagttaagcatgttacatatttctctagtagacaaaaatcctatgcttctaagaatgagacttattttcccatcaatttattatatcattatcatcaccaccatctctcttcttaaaatttatctcctacctcacccagactgcataatccaaatatttaaaaactctgaacatgaactactaggcttttcaaaatgtatgtgtagtgtgtgcgtgcacgttcacatttaaatgatggcaaaaatgtgtttcagggtctttttttaactcaaacaatttcacacctactttaatttttcaatcctgcattcagaagctaatatatttagaataaattctaatgaagccatggaaactatttaatgttatgtcaattattggtgattgtgtgggcaacaatgcagcctgtgtggctgattggaaattatttctcttttataaaaaagaaatcttgaagggttccaacttgctacgattaacgatacaagtaagcttaatttataactccaataagagcaaagaaagatattttttcaatgtggactggaaaaactgtgaaaatcatgataccaagatgttaccttcccattgtattcttaaagatttcagtttcttatttttgaaataatttgaggtgaaaatacccagtattaacattgaaagtagtaagcttttctgaagtgtcttattgtttgcaagtctttaactgaacttagagcctcaatgtgaacactatcagggtcacgtgttgtccctagcaccatctggtcacacagagaagtcctttagaactactgtagccttgggattggaaacacatgctgtgttctacctgaaagtgttagctttcattgtgaattacccatacatatctctgaaatccaagatggttatttatggtgggtgactctgaaatgaaccagatcagcaatctaatatgacagcgtatctcccaatgaagatgatgacagcccaggattttctggatttatttagtatagaaatgagacagagagagagagaaagagagagaactcaggatggtctttcacaaaatagattaagaacaaactatttacttgattgtgctgtttgagtcaatcattgaatagaaagatcagaaaatttaaatttaaaaatcagcacattcataacacataaaccaaatgagttagggaaactgaaaagcccacctacttaacttctccctaatattctttaagagcatgaacattttcgcatttcaaagaaaaacaaagaaacgaaactagcaaaagacaatataaaattagtacttgaaaccattacaacagaataacaagtctaataaagatggcacaacaagtgtccagtttaactaaccacttgtgtcccaagcatatggaaatgactgataaactatcagaaggaaagacaaacaaaaacatagcaaattcaaaagcaatataatttctctctgaaccaaaaggacaacagagaaacacagtgttaaagtgggctgaaggtgcagctgcgctaggctgtttgtaagcggacaaatggaacaaggacttgtgctcctgtgtagtattaggaacttagcatcctctataaagacaggttaccaaagcaaagttctttgctagaaatcagaccctgaattatcacttcccatcttctttagctgggaaaatgtttgggaccatgaaattttaaagaactcaggaactaggaaattgaaaatataaagataggatctatgaccagaaatctttgttatccatttgatggccctgtgattttctcttgtttatgattaataaatggcatcgtaagaaaaactagagtctgcatggcacttaaggggtttggtggataaaattatacaaacaagcaacgggagtttattcaagataaattttctgtttgtgtgtgtgtgtgtgtgtgtgtgacagaaagagagagaggaagaaaatgagaaagaaaaaattctccctttaaagataagcctgtacatgagaattctaaaacataatgagaaatttcatgctaagaacttaggcaaacaaaataatcagtattacgaatatatatttattacaaattaaatcaatttaaagaaacaatatgtaaagactatgaaactgatacgtttaaacaaaggaaaattacaaatcaatatccacaatgtcattttctgccatttatctacaaagaccaataatactattttgaagaacaaagtatggggacttgtcctattatatatcaacatttatccaaaaatggcaattaagacagagtggtcttgttgaaatgattacaaacggacaagtagaacagacatcctagaaactggtatatttatgtgtgaaaactgaaaatatgaaatagatggcaattcaaatatgagggggaaagtataaatgataccggaaaattggttattcgtgtaaaaaaataaaattagattgtgcatcacagcagatcaaaactaaatccaggtggataaaagaactggatgtgaaaatcaaaattgcaacacttttagaatactatatagaaaactggctcaatgactacaagatgggaaagtatgcattacaaatgatgaaacaatgacagtatgaagaaaataattctatcactggcttaggttgtaataaaaaatatttggtaacattaccataaacgaagtggaatgaaaagtggaatcttggggaaattttatttgaaaaaatgaatagcttaaaaaagattaatatatagaattggtaaatagctacgaataaaaataatggttagtttatggatagtatacccataaaatgggaaactctgcagctgttaaataataaagcagatctatattttttgataaggaaatatatctatgaaatgttattaatgaaatcaagcaagatttagaacagtgtgtatagtatgctacctttgaatatgtgtatttgaaaagcacatacattttctgtactcagtaggttacaagatgcaacaggaacgaaactattcttaggaaaggaatttggctaaaaaataaaaggtaagacaataccaggggctagaaatggggtacttcatacactgccaatgtaaacttaaattgacataaacagggagcaatttcatagtttctaattaagttgaatatgtgcatgttgtttgatccattagtttcactctaaggcatacacctggaacagtggttctcagagtgagctggggacccttggggaggtccttgagatgcttgtagatggtcaggaaaggacaagttagatttatattattactaagatattatttgcctttttcaccatattgacttgtgtactaatggagtaaaatcaatgactaaaactgatagcacattaacatgaatcaagatggagtaacaaaacatactagtaaacatcttatttttcatgatcacatattcacagtggaaaataaaagacaagaagaaaaaagcaagttttatttaacaatatctttaacgaaacaaaaaaattagtaactgcactaaatcttaaaccttgagaatgtatctttaaaaaatattattggtgacaaaatgggaggtacacacaaagtacttctactttataccaaagtagataatgtcttaaggaaatgcacttctgtgattgagttccaaattgaactagctgcttttattcatggactgccattttaattgaaaagataaatgacaaaccattgttttctacttactagtttttccttctatttttagttgacatataatacttggatatatttttgggatactgagtggcactttgatacatgtatacaatgtgtaatgatcaaatcagggtaattaacattttcatcacttcaaacatttgtaatttctttgtggtgggacatttaaaatcctcttttctagctttttgaaaatacacaataaattactgttaaccatattgacactacagtgctatagagcactagaaattattcctcctatctagctgcaattttgtatcccttaaccaacctctcttttattcctcctcctcattaccctcccagtccctaataactactattttattatctatttttatgagctcagagctgtttttcaactccgacatgtgagtgaaaacatgtgctatttgtctttctgtgtctgtctcatttcatttagcacaatgtcctccaggcttaacccatgtggttgcaaataacaggatttcattcatttttatgcccaaatagtatttcattatgtatacatactggattttctttatgcattaacctgctgatggatattgcatatcttggctattgtaaatagtgcttcaatacacatgggggtgtgggtatccctttgatatatggattttttaaaaatgtatacccaatagtggaattgctggatcatgtggtagttttatttttagttttttgagaaacgtccatactgttttcaataatgacttaataatttacattcccaccaacagtatacgagggttatcttttttccacatattcaccagcctttgtggtttttttgtctttttgatgatagtaattttaactgggacgagatgatatctcattgtggtattaatttacgttcactaatgattagtgctgctgtacattttttcatatacctttggccacttgtatttttttgaaaaatatctattcagactctttgcctattttgtaatgagaattttgttttattttgttccataatgttgtgttttgttttttgtttgtttgtttgttttgcttttgagttgagttccttgtatactctggatatcagttccttgctggatatatagtttgtaaatatagtccctcattcttcagattgtctctttactctgttgattgtttcttttgctgtgcagaagctttttagcttaatgtagcctcatttgtctatttttgtttgtgttgcccaagcttttgaagtctttcctatagcatctttgcctacaataatgtcgtggagctttccctctatgttttcttctagtagttttacagtttcaggtcttacattaaagtattttatgtattttgagttgatttgtgttcattcttctgcatatgagtatccagttttcccatcatcgttggttgagtaagttgttctttttctaatatataatcttgaagcctcctccaaaagttagttggcttcaaatacatggatttatttctgggttctctgttttattcaattggtctatgttttctgtttcaatacgaatttcatggtgttttgtctactatagctttgtcaaactattgttatttagacaagcttttggcagacattttctgagaaatgaagggagtgtaccacttcaaggaaaacaaatgagagtgtttgttgccaatgatcttacttgaaaattcaagcaaaaatgggaatttttcaaaaatttttatctaccatgcaatcttgaccgtttcctaatacttaaagacttttctgatgagtttggcaatgaaatccataaatataactttttatattgtataaatgaaaagatctgcgtttggaaggtctacatactttagggaaccaccgttttctaaatcaccaattcaagatgttacaaattagtcatcagtaaaaatccaaagcacaagaaaaacaaatggagtttaacgtaaataagtatacaacttttcattgatttggtttcagattctacattgcaaataacctttaagaaactaccacctattgagttttggtgtaatatcaaagaatatccataattacccaaaaaggttattaagacactgctgtcttttcttacctcatttctgcctggggctggattttactgatatactgcaaagaagatgtttcactccagattggattaggaaaattcagatggcatttttttttttttttttggtcagaaatcaaagatattttccaaaatataaaatgatgtcacatttctcactacatgtcttattttataattataattatttttcctaagtgtcatttattttaatatgtaattggtttattattatatttaaattagttaaaacataaatatattaacactttttagttttaattcttaaaactaaatactgatacatataacccacataaacaaaagaaaggctctttgaggtccacaataatttttaagagtgtaaactggtcctgagaccaaaacattttagaactgctgctctagagaaaatattttcaattgttgtaaaatatacgtaacacaaaatttaccatcttatttcaagtttatagttcggtagtgttcagtatattcacattgttgtataacctacataaattcataaacaggaacacaaaaaaatgaaaaagatattcaatgaagcatcatttataacatcgtttataattgtatttagattgtttatgtgggaagcaatgtatctatcaagagaaaaaagttaattttatattaatatctataaattctattgtgtgtttatacaatgcaattatatttttccattgaaatgaacaaattaaatctacatatatcaacatcgagaaatttcaaaattataatgccatgcaagaaagcaagctactgaataaagtgtataggtgaatataatttatcaaaatatgtaatgtatgtaaagcttgaaaatatgcaaacagtgttgaatattgattattgacacatacacaggaagtagtaatatatagatgtgtgtaggaatgatttatacttattcagaaaaatgattacttctggaagggcatggagggagatgaattcaggcagggccacactggggctttaactgtatctataatatcttttccaaaaaagaaaagtagaaaataactgaatataattaaccaatgttaattaaccaaaattaaccactctgtcacccaggctggagtgcagtggtgcaatcatggctcactgcagcctcaacctctcgagttcaaccaatcctcccacctcagcctactgagcacctgagaccactggcacccgccagcacggcggttttttaatttttatttttttgtagagacaggatctctcaatgttgcccaggctggtctggaactcctggcctcaagaaatcctcctgccttggcctcctaaagtgctagaattataggcatgaaccactgtgcccagctagaattttccaaagatggaaagctgggtagtagtaaaaatatgttctccatgtatccaaaatactattctatatatccccagtgagagagattgacagcaaataaaagtatcctcctttccttcattcagttgacaaatattccttgagcacaggggatacaattgtgagctaaaatgcatttcctgatctcaaggggctgacattccaacagaacaacctatatagacccaggcattgttcttatgttaatgtatttaaagatgatctttattttgagaggaatgggaagtagttttaaatggttttgaatttcatcagactcttttgatcactgggctgaattgtcgccctgggactgagtccctaccttttccttatcacacaattaaataaaaaggtagagacattaattcatcagatatttattgagtgcttgctatgttccgcacgctgttctatgtaaatatagatacagcagtgaacaagacaaagttcctctcttaatggagcttgtaatcaagtttgacatcatataaaattcaactatgcatttatttattcaataaatatttattgaataatcattatgtgccagatactgttttagaaactgagaatctaagagtgaacaagacagactaagttttttttttcttttctttaggatatttccctcaaggggagacatacaataaaaagacaccaaaaaatagatacttggtaaacaagtatacaaggtaacatatagtcgtaagtattatgaagataacagaacagggtgatggttgtgagattgatgggtaagagttgagaaaccctttctaatgagatattttcacagcaataggaaatgcatgagcaaatgagccgtggatttctggcagagaagaggaaatgcaaatgcttctaggaggagcatgcttagtgcatttgaggagcagcatggaagccagtgtgactgtcactgagtaaccaagcagagcgcttggagctcagatcagtgtggtaggaaagagctagatcatggaggagactgtctcaaagaagaatatctctgtaaatgtctgtgacacagttgtatgctataaatattgcaatgaactttcttcatttagccattcaaaggcccttgcccctgaccttttggtcacattgagtggttaatggggttataatcccagaaagtgaaagtagaatggggtaaaaaattcctctttggttgggctttcactcttagacactgttacagtaaatgagagagagccaggacacaagaggtgcactcagctccataggccaggtcaccacacaacctggaagagagttcaaccctgatatttgtttataatcacctagttgcacaaaatgtaaacctgtccatgaccattagctcctccctgtgcctcaaataatggggttaaaagaatggactcagaactagagtgtctatactattagtgagaggaggggccagctggacttcctgggtcaagtaggggctcagaaagctgtgaaactcactcatttcctgcatcagggcttccttcggtcctggatggataatattgaagatatatgcttaaaatattcctaacaccaggatttgtgcatgtgttttcttccccaagaaagctataaacactgaaaattttgctctaagtttccctgtgtcctttctccctctctcccttccccctcctccgagactaaagtaaaaggaatattaactgcccgtttttctgtgaccagcagaccttatctatgctcccaattccaattccttgtaaacatactttgtaaagtcctgtgagatcttgtcttttttgccatgccactgaaaggtcataaaatagatgaaacctaagttgcaattccggttttcctcaagatctaaaacatgtcacaagtggttaattgtctgtgtttctcgctctggtaacatcttcccactgcacgtatttcctgccttaaagagtttaaaaggcaatcgtataatctaactctggctacccgttcgggaccccttccacactgtggaagctttgttgtgtcactctgctcaataaagcctacagctttttctctctctcggtccttgtctccatcactcgccgcggtccgccaccacaccaattctttggcgtggctaggcaagaaccttaagcgttacattaggttggtgcaaaagtaattgtggttttttcctgttaaaggtaatggattaataggattctgaattcatctttctgagctgtgtggcattagacaaatggcttcatttctctacagctcattctccttactgataaaatggggctaataatcaaatgtttgccatagggctgctgtgagagttaaatgtaataattcatgtaaaatcttagactcatacatgccccatagtgttttaaaatactggccatcatcatcgttattgatattattatattttaatgacaattattgtgtgctttttttttttttgtggagatggagtttttctcttgttgcccaggctagagtgcaatggcacaatctcggctcaccgcaaactccgcctcctgggttcaaattattcgcctgcgtcagcctccccggtagctgggatttcaggcgtgtgccaccacaccctgctaattttgtatttttagtagagacggggtttctccatgttggtcaggctggtctcgaactcccgacctcaggtgatccacccgccttagcctcccaaagtgctgggattacatgtgtgagccaccgcacccggtggcaattattgttaacccaatatccattagattaattcatctttcatgtgatgtatgaatttcctaaatctgcttgttgggtatctgccctcaactttattcaattcctgacattccagctaatgtggtctttttaaagctttatgataatgtacatgctcttgcttaaaagccatgttttcacagggagtggtggcttatgcctgtaatcccagaactttgagaggccaaggtgggcagattgcctgagtccaggagttcaagaccagcctggaaaatatggcgaaacctcttctctactaaaaacacaaaacattagctggatgtggtggcatgtgcctgtaatctcagctactcaggaggctgaggtgggagaatcacctgagcccagtaggtctagactgtagtaagcagagactgcaccactgcacttttagcctgggcaaccagagtgagactgtctgaaaaaaaaaaagaaaataaaaaaagcaatgtctccactgcccttatgatataaagatcaacttcttaacatgactttcaatgtgtgtcatgatctgttcgtggttttctaatttcacttctcatcactattttccttggatggttagtgtcagcctctcttaactgtgttcaatattctaggtgcatgatgctcatctgtcttggcctagagaagttgttcttaaactatgatctatggaccagccacatcactatcagcaccaccaaggaactcataagaaatgcaaattattaggctccacccccaacctattgaatcagaaattatgggggcgggttctggtatatgttctttacgaaaaccagcagatgattctgttgcacaatcaagtttgagaactgctggcctagatatctttttccaaggtcctcaagattttgcttgaagaacgtacaagaaattttcaagatttatcgtagatcttacctcttactctctaagaaagctccttgcattcaccttccattttatttgttcatctttccctttagactatgatggtttggaaagcatagaagtgtcttcataaaatttgcatacccaaaatatagcatagtaccttaatgtatcatatgtggttcaataaattatgtagcaataagtgaaagaataaataaataaatgaacagatagtatgagaaaatattatcttaacagtgggcactattagggagagaaccatgtttaggaaaatgttttcacatgccacttatgggtcaaaagtgacatcctgaaggcatgaattacaagggaatggaaaaaacagttaaattgctctgcataagaggtgaacaagaatatctgaagttggataaataaaggatgagataaccaaaagagagaggttagcaaatatgacagaaagatgaagaattttagagaaaagttttgagtgagaaaagtccagtgaggctttgaagaatagatacatagaatgttcatgtctgggtttgtgatattgcaataagagatgtcctctgttggtcatcaagtatacattaaagtataatgaggctgtattcaacatagcttgtgtggccatgttgcggagattactgtggcacaccatacaagaaactatgtgctgccctacagtaacctctctgtgatgtctctagagataacctaattgtcaggaagaaggcagtggtccagaagtcccaggcagtggagccgaggaaggtgcaagaagctgcttccacctgaaaataattcaatcatagatatatcttttttcttgttattcttgtcattgttgctgctgcatctctcaaatatactagatgggggccatcttagtaggtggaggacaggtaatatcagtgttacatatttgataactttaaattatattcacaaattctctgataggcttcctttcaagaagtgaagctgaactcattttcagtatgagctagacttagtgacttgcttccagcaatgagaatatggtggaagtgatgagatgtcacttccagtgggtacagaaggactgtgacttccttcttgctgttctccagcaccccctcacaatcaactctcttcctttgccctctatccagtatccagtgaggaactgaggccacataagtgggcttggaaatgagtcccttaaccccagtgatgccttcagatgattgaagcactgaccagcagcttgacttgcaagatcatgagagactctgagctgtaaccactcagctaagtagcttttggatttctgacccatagaaacagtgatgtagcaagcatttgttttttaagcttcaaagatgtaaataatgtgttacacagcaatagataacggatacccatatggttatcctatcttatgaggaataaactgaaatctcaagaggtcaatgggtttgtcccatgaacaaaaagctataaattcttagagctgccattcaaaccctagccttgtaactcctaattcattagtcctaccattatatcagactgccatcagtcatgtgtaacttatttattatattcccaaacctagaatataattctaagggcattattaaatcttaatcagaaatatcaaaatatgaaggtccatggtttaatcattgtctttgtatatcctaaccaagaacatgcgtaccaactccaaaactgcaaaaactaattattagaacaagaaagtagcaagggactttcgagatatctgtaataaagtttcactatgtagacagagagaacccctgagagaggaaattactggaaaatgccacagcttgagtaagagatggaacaaagactcacctcaactgtacaaagaaaacgtttttgaaatttagttttaatgtagttagttccttgaggacagagacttacaagttgatgtgctcaaagcttggcacaatggctggaacagaatgtcaagacactcttttgagacagagtctcgccctgtaccctggctggagtgcaatggtgcgatcttggctcactgaaacctccgcctccaagcgagtctcctgcttcagcctcccaagtagctgggattacagatgtgtgccaccacacctggctaacttttgtatctttagtagagatggggtttcaccatgttggccaggctggtctcaaactcctgactttgtgatccgcccgcctcagcctcccaaagttctgggattacaggcacgagccaccgcaccaggcccaaaacactcttatctagcctcttgctagattaataatgcactctattacttctgtaaaatatagtgatgaatgctctaaggcatactgaaaactcacagctaattgcctacccacttgtatacatctgcttccacctgttgagttgtatgctcaccaacagcctttatgttcatttccaaatcactttatgccaaatgtacaaattattataataacttgatttgattgaaaattatagaaactaattaaatataagtttaaaatgagaagtattctttttatgaaacctcaaactattggaaaagatttgataaaggaaatttgttaattaaaaaatttttactatttttaattttttttatacaattagatatgggagagagtttagaaaaaataaaacaaaaatctagaagcattctgcttaaggggtgtcctcaagtttctgctacatttcatagaaggtgaaacttaatattagagatgatgccttatcatgtggtttacaatgataagcttagtcaaaggacccacacacatttaaaaggccatgagaaagaaaaatgaggccaacacagagaaacataaatgtttgtttatattatgtaaaatacatacgttatctaagataagtatatgtaatttgtaaatgattttcagcttcagccaatgttttcaattaatcaactaagtattggtcacaattagataataaggcttctgctgtaatgtatatgaagtgtgtaataaatgaattaatgccaactctgatgaagtagataaaacaaggcaccctacagatgtaaggcatttttcagtttatttggaaacttgtcaatactcatctaatttacaccgaaatttcaaccttgtttttcatcgttgtgtaattagaagacatctgaacaaaaataaagaacttccaagtctttgtttgtttcatgttgcacttatctccctccttggcagggtaggtttctttctttgggtgttttgtgaaatttatcccttggcagctctagttgattggcttacatactgggtgagagtttgtaagcagagtagtgtttccagtgccatctacaatgtgatggtggtttctgacaagagtttccagtgctgctaagcaaccattactgatggctaaaaatagggaacaactatcatatttatgggactctgaaagcttaaggagcttttacaagccaattgctttggtacataattactataagattcagcttttgaaacggattaaaatatattgtgtgtgaatctgcaataattttctacagccaaaactgttcctcagattaaaggctttgtttgcattgatttcttttctatttaaaaatattaatcgtacttcatctgggtagacattttcttcccgtgtccttatttccctgaattaaagagatgcaataatatataaacaatacaaatatggagggtagatttgaaacttccttctgaaggaactgttgatttcttcacacttgtgtctttatatattaccattttatcatgaatccgtttacctctgcattatttcatatttgcattcattaacattaattacttatagttaccattttttatctctttatcaaccatccctcttttcatctgtgcatttatttattgacctagctgccctgcaagcgtccatcttcatcaactctttatctatttgtctagtatcatataatgtcttctctttattttgaagttgtacttaaaaccattgcaaaacttgcatcactatccctttctgactccttacatataaaaaaatgacttgtagcacctaacacgccccacaaataacacatctaatttcaagctccatgagggcagaggacatatatctctttgtgctcacattgtgtctccaatcctagtacagtgagtgactggcctttaatagttgcccaatacatattcattaaatgaatgcataaatatctcccatgtgtttatatccttatccatttctcactctttttgaccatcgctccatcagtttctttctcatcatcatccttttattacctactttcacttctacaagcctgtctgtcaggtttttcactcatcatcccaactattcatctatccatttctatacctaaagctccctatctgtatctaagcagctatctaacattttgttaatatattacaagatatttttatttgttcataattgcatctatgcctctttcatctccttgtcattcattaatccatcattctccaccatgcttttaacctaagttatattgcgtatcgttttaatatcgaatgataaggtctgcacagtttccagtgaaaggtccaaaggaaggatgacagagagtttgcacctttctccatttattttatacgaattcaattatacaaattcagcaaataaaaataaaaaagaagagaaaaaaacagcaacttaagtagtgcctgtcacttcatttaatgaatgtagccaataaatgaaacatgatatatcgattcctaaagtcctcctaatgagattacaaagtttaagaacacgtattcatacaaaacgcccttgcaacacaagccgactatttttttgtgtagctcacccagaaaaacagcaatttgttccaaatttttagttaaaaatagctatgtcggttctgctaaccaacagtagtatgcttaagaccacactcctatctctacacattcaaagtcacagccacctaactgcatatagtagaatatttttagccatttcaaatattttagctatttcaaatggctttttcttttttataagccacaattgattttaccatctcaaatttttctgagctaacaatcattttaatcattttatctagtctctcagtttctttcataatgcagaatcttccattctggatcccctgtcctcacactgtcagctggactgttctgtaggactcttaaatggctgcaatgctgaaatttcccttattgctttattggattctatgtcttcatcttcctggctttgcatttttcctagaggatattctcaaaaaacatcttgaaatacatgaaatgagcgaaatgaacatgttcaagaccttcctgcttgaaacttttttttttttttttttttttttttgtttgagacggagtctcgctctgtcgtctgtcgcccaggctggagtgcagtggcgcgatctcggctcactgcaagctccgcctcctgggttcacgccattctcctgcctcagcctcccgagtagctgggactacaggcgccccgccacaatgcccggctaattttctgtatttttagtagagacagggtttcaccatgttagccaggatggtctcgatctcctgacctcgtgatccacccccccacagcctcccaaagtgctgggattacaggcatgagccaccgcgcccggccgaaaagttctttattttcacctttacatttgatagtttagggagcaaaaactttctcacatccgtgcattttcttctcaaagtttgaagcatttcttcattggtttctcgcattcagcataattgatgaaaagtttgatgtcagaactacacattcttttgtacgtaactgactgcttatcaacaactccagtcctagctcccaggaacactttgtttttgtattttctttgctgttataaaattttacaattatatagaaaagaaaggttatcaattttcatttattgttctgggtattttgatatgaaaagttgtgtcctctttgggaaagtctcttctattatttactgaatatgttttactcatagattctgtattctccctttatagaatgcccaataatcatatattaaaactacgaaacaaagactaattttatatttttccacatttttaatcttttttatgagatttatttaaatttaatttcaagtttttatattaaaaattttgttggtgattttaaatttcaaagacatttttctttttccatagttgtgtgtttcttcctcctttttttttttggattcactctctggaaacttactatagtttttttattcttttaattttgtttctttcgtctggactgatttgctttttgttttttcttattttctttctgtacatgtttttcttagatgtgtggtgatatttctttgttcatattttagaatgaagcagcaaaaacctactagagactgttgtttacatggttggagatttcaaatgatgggttttagtttatcataaaaaagagtagaagcttgaatgtatgttctggaactactaaattgcagaacacccattaatttgctatgagccgaaaatatccaaacaataacctctgttttctttaactaattttatttctctagtgaataattttaattttttttcaagcagttaaatacattactactaggattgttccacttctggtgttacaaggtgagaatcttcttagacctgtgacccagtgaaattgttgaaaattatacatatattttatatatatgttgtatttattatatatgtacgtgtgtgtgcacgcacgtgcgtgtgtgtctacatttaagtctcaggaaatggtactaaatgtatatagcaaattaagaaacctttattccaaaaatctattaaaattcttcaagaacagtgagagtctgtggttattgaaccaagaaccattctctttttcctctgtcagagctcagtgagccagaaactccattccagactgatgcagccaaaaatggaggaattcttctgcctccagcttttagtcacgggactaccctcccaggaagcatgggcaggatgttgacattcctcatccagtccccagctacctgttgctaaattctgggtgagtgaaactaagaaataggagcttcctttttcttcccagctcacgcttgtgagactaaggctctaccttgggtgaaacactgccaagaatattgcgtcactgattagccttttcctctcttgcaggatggcaacttcatgctgggagaggcaagcagaagatctgagtcttctcctggaactgagcacccagtcttaaactgggagtgtcgctcagggataagtgtgacgttgtccccattttcaactccaaagccatggctcaaggatttttcttgggaagaggaggctataaacagagtgctccaaatatcgtcccaaagaaattgatttaatttgcaacagagtgtggaaaagttcaaatctaaaagtgttactgtggactgaatttagtcccacccaaatttacaagatgaagctctaacccccaacgtgatggcacttggagatggagcctttgagagatacttaggtttagacaaggtcactgggggggggctctcattatgagatttataagaagagacacaggagcttatctgctttctctctctctctctctttctgccagccacatgaagacacagcaaaaaagcaatcatctccaagccagaaagagaacctttccagaaacgtatcatgctggcctcttgacattatatataacagaaatgtattgcacagttttggtgactgggaagtccaagatagaggcacaggcagatttgttctctggtgaagacccacttcctggttcatagatggcagttctatgccgtaccttcgtataatggatgtggacaaaagaactcttgggacctcttttataaagtcattcatcccattcatgaagattccactctcatgacctaatcacatcccataggccccagctcttaataacatcacattggatattggattttaacatatgaattttgggggggagtcacaaccattgtctatagcaccaacttcagataattgttaaaaatcacttcttcattgtggttttcttccccttgtgtttattgttgtgcatttttgtcatttaggaggctataaaaacagcttgtttgctggagctttgcacatcattgcttcattcaaaagagaatctcagaaaattactgtgatgtctataatctaacaaagagaatcatggatgcactaagtatatactgtgaatttaactcagatgctcatgaacaaatggtttctttatacttgtatatcagctcctctatattaaagatgtagctaattaaacatatgtttattttttatgattattttagacatttttcttcttgagttttgcttgttctttgttgctaaccaaattgtttgaaaattcttaggaaaattacttatacctacaaattacgtatgatgtctaatttaaactctaaacagactctatttctcatgttacatagtggagaaggtataactccatatggttaattgttattttgaacctgaagtcttaacttggttaactatatcaccacagagtagatattcatcaatctcatgagcataaaccagtaattactattttaagtatgaacatattcttagtttcaggcatttttgtattaattagctaaccagttgttttggcttctgatacatctgttagtggggaattttttttaattcaatacttaaatggattaaagcctgcatgtgattgagagatgtggaaatattcctgcatatacaccacatatgtgcagaatttaaaggttaaacatttctatctcctattaaaatgttatgtaattaaatgctgaaatttaaaaagctgatttttgtttaaaatacacatgttctaaatttagaaattctaaaataaaatgttactacctcattagtatttttcaatttaaattaattttttggtgctttttagcttttaggttcagggatacatgtttaagtttgttacatatgtgactttcaaactctaacttcaggaagtcattacttccagtaggttatgttctggtcattcattcctctatcactattaccacccacagagctcatatgagctatgctggccctcaacatttctgatggaagagaataaatacatggttttgttgctctcttttacaaaatcaaatgttactttacactagaccaatgtttcctaagcctaactgtgtaccacaaagcacacttggagagatttttagtttgtttcgtttgtttgttaactgtaaatttccagattctatttcaaatctaatgaaaaggaatctctatatgtggaattcagggagatatatatatatatattttttttaagcatgtcttctagtgtttctaatgccaccttgaaaccacagaatcatttgaggaaaccaatgtaattgacatttattacactcctccacatcagtatgaagggcatgagagcctaggttttgtagtgttcaccactgaattcccagtataaaacatagtatctgataggtcttagtcctttattaaacattagaatgagaaaataaatgagtttatgaatttaatgtctgtatcactataatgcaagtggaaggaacagggaaccagaaaagacctcagcctaagaacaaaggaagacaacttagtgacaattaccctgttatcaatagaagaataatgccttaaggatctgtcaggaccatttgtagttggaaatctgatttcaggaggctataatagcagcttgtgtcctggagcttttcacatcattgctttattcaagagagaatcatagaaacctactgtgatgtcagtaatctagcaaagagaatcatggctgcactaagtatatactgtgaatttaacttagatgttcatgaatgaatggtttctttatacttgtatattaaagatgtagctagttaaacatatgtttttatgtctaaacctaaacctatcatacacataatgtatgatgtctaatttaaaccctaaacagattctatttctcatgtaacacagtagatactactgtattctctgatgattcagtgattgttgtacaaaatgatttttaaactcacacatgttccctaaaccatatcaagcagggttgattgattgtataccaatcagcatcatctttttttttattgtgttcagaaatggcagcataggtattaaaagcttattaacatccttacaggttggctgcaaaacacgcgatcagtgtcagctgtggcctgtatagtcacaaaggttttctgttcttgttaaaaattgtactttctgaagcttttaagaaaattatattttgtagtttctttttgggggggctggggggcatacaaggaaacaaaacctcaattcatgagccttttaaacatagtcgtgtttgtctccctcacagatgtttttatgtttctattttttatatattcttttttaaccattcaatagaatcagatgattcagtcttcctcaccagcccattattattagtccatttttctacagatcttctctataagatatacagatgtaccgtatgaactcatttcttccctctctttctgcttttgaaattgatctctccattattctaagtgggttttgataatattctcttcatgcaataattccaaacatattcttgacatacctcctttgccctgaatacccataagcatcattactcaaaatagggaggatagagctgtgagtggtgacatggcctggataggctatatgtgcctttaatataaattcaataatttagaacaatagttttcagaaaaaagtgttgattttggttttgactacagtaatatgagcatgcaaacaaatttggctattgaatgatacaaattattaaatattttcctgctttatgatttagcagatttgtatgtgtgtgtgcttaactttgccttgtaatttgttagctagtaattaaataagagccagtttgtcaaaaacagaaatgatgaaattaaattgcattataaattaaagcatacattcccctcctttgtttcaagcttcaaaagcttgtgtaggctcaagtcctgtggccttaactacatatttggatctttacctgggtcttcaaagtccatatgccagtaattgaatgtaacctatttccatgctcccattcccaaattatctcctttcttctacccatctaagactatatatgttatcctcaagaaatagaagtgaagatcagacattggccctcactatattgtgagtgtgctgaggtagagcctccttattcaaggacagcctaaacagatacctcagagttaccaggcgtaactgaaatacaattgaaaaaatactatggtattctaggtttatactatttcttttacaacctgagttaataccatctcatatagaaacaaacattgaaaatgttctagagaaaactatcctactgataaaagtgcacacaattattactgagccctatagccatgccaaacaaagttaatttaaaaaaatggaagattaacttataaattccaagaggaaagcgcctgaaagccactgacgtagccggcggaggaccactgtgacgcacttgtgtactgcgtcagcactgtgtatccttggcgacgtcggcgctcgagctgcactcggccgggctcttggcagcaccctgtgctctgagggtgtcttgcccgccgggcgccgtggctcacgcctgtaatcccaacactttgggaggccgaggcgggcggatcacctgaggtcatgagttggagaccagcctggccaacatggcgaaagcccatctctactaaaaatacaaaaaattacccgggcgtggaggtgggcccctgtaatcccagctactcgggaggctgaggcacgagaatcgcttgaaactgagaggcgagggttgcagtgagctgagatcgcgccactgcactcaagcctgggcgagagtaagacttcctaaaaaaaaaaaaaaaaaagcgcattctcaaatcccgcagtcagtcctgcgggtggaacacttagaggaaaagtcagacctctctatatgcaggcccctccaatactgtattttctgtcggcttataagtggacccaggcagttcaaacccatgttattcaagggtcaactgtgtatataggaacagccattcgcctggcacagtggctcaagccggtagccccagcactttgggaggtcgaggcgggaggatcccaagagttccaggttacaatgaactgtgatagcgccactgcattccatcctgggcaccagagtgagacacttgtctcaaaaaaaaaaaaaaaaaaggaaaaggaatagccccccaaatctatatatatttcactagcagaataacagaacataccaaaatttaacagtaataatgtaaagattttcagccgtctgtattttccaaatcttcaaaaatgtctattttgggaatttggatattaaaatcttacttttaaaacaaaatttaacaaaacatttttaatagtgagagccttttagattttaaaagctcacatttgtgtaaacattacagtcttatgtggacaaatatcaaatgcgttgatatttttaactggaaatttgggctattttggttgtggataattttttatcctttttgtttttccatattttctaaattttgatataatgaacaagtattgcctttctaaaaaaggaaaaacagcattttgttttatttcaaccatattggatgtgaataaaagaaaagaaaaagatgattctgagcttaccagtgtgtgtgacccacattaacagaaatgacatgtaaagaaaatctagtttggagtggaaaatcctattttaggtagttgatttctttcacttgaggtaccatttatctatccatgtggggatagcctagtaggaagatgaaatggtaggacagagatcttgatggaagccagtagttgtggcacagttctgaggcccagctactccaaaggcagagggggaaacatccctttagcccaggagttggagactgcaatgagttatgttcatgcctttgcactccagcctctggaagagaatgagattcctatctctaaaatgaaaagagggccaggcacgatggctcacgcctgtaatcccagcacactgggaggcccagatgggtggattgcttgaggccaggagttcaagaccagcctggccaacatggtgaaaccctatctctactaaaaatgcaaaaattaactgggtatggtggtgcacgcctgtaatcccagcttctttggatggctgaggcaccagaattgcttgaacgtgggaggtggaggttgcagtgagctgggatcgtgccagtgcactccagcctgggtgacagagcagactctgtctcaaataataagaataataatatttaattaatttaaaaataaaaaccaaaagagaagatctgatggacttagaagtcatatatctcaggtgataggtgaaaccacaagtttgccttgaaaagtgtgttgatgacaatagccatacctaacaagtacttgctgtgttccaaagctctttttgttagcacttcatttgtattaactaatatcattcttccaccaactttgtaagggtactgttattatcctcagtttttacagataaggaaagcaaaagacagccaggtaccatggctcatgcctgtaatccaaaactttgggaggctgaggtgggaggatcacttgagcccagtagttcaagaccatcctgggcaacatagcaacaccctgtgcttacaaaaaaagagaaattaaaaactagccaggcatggtggtacatgccagtagtcccagctatttgggagactgaagcaggaggatctcttgaggctaggtgttggaggctgcagtgagctatgttcactccactgcactccagcttaggtgacagagaaagaccctgtctcaaaaaaaaaaaaaaaaaaaaaggaaaccaagagaatgagcactgaagcaacttgcccaaacacactcacctagtaaaaatggtatcattaattcatttatgctgaatatgttgaaaaggagtgcccaaagagagaaccttcttttctttctttctttcttttttttttttttttgagacggagtttcactctgtggtccaggctggactccagtggcgcaatctcggctcattgcaacctctgcctcccaggttcaagcaattcttgtgcctcagcctcccgagtagctgggattacaggtacgtgccatcacacctggctaattgttgtatttttagtagagacggggtttcaccatgttggacaggctggtcttgaactcctggcctccagtgaaccatcttagcctcccaaagtgctcggatacaggtgcccggcatccaccgcgcccagcatccaaagagagaatcttcttgaggaactcaaaagacttttctcttttggataagcagttcatatttctgcatttattagggattttcacattttacttcatttcacactactttttttttgttcagtggtataacattttcaccatggcactgaaaattccatttgcattaatgtccaatgtcatatattcctaccatgttgcaaatacagttcatttgtccagctttactgaggtataattcacaaataaaaattgtatacctttactaggtacaacatgatgttttgctatccaagcatacctcattttattgcactacattttattgtacttcacagatactatgtttttgacaaattgaaagtttatgcccactctgtgtcaaacaaatctttctgcatcatttttcttttttgagacagagtctcacactgccgcccaggctggagtacagtggcacgatctcagctcactgcaacctcctgtggcaggccaggtctcactaatgcagacttccataacaactgtttcagtaatgactgaatgaagttaaatactaaaagccagtgcccttatacaaaggctgggatgtaacaaaaggccatcaaaacttttgcctaggcctgtcctgggccttaaagcatgacaaaataatgaaggaattctttttatttatttatttttctttttgagatggagtcttgctttgtctgaatatgtcagcttgcttgataggtaacttgattgagtctaggtgttgcccatgcctactctgatctttaccctcaacctaaatagcatatgtatagttctcttgattaatccttaaactaactccctaccttacccccaccaaactagtatttctcctcaaggaaaatactgtctgctcacactggggccatggaagaaccacctgacatgagtttttgtgattttctgtttatctcaaaacttggccttcggcatttacatcttggatggctttttgtatctccattttctctttatagtttcataaacagttcctcttgaaaaattatcagtggtaaaatctgatgagtatcaatagtctccaaagtgctttttatcttcatcctttatccaatacattcttacaccctctgaaattgtttagtttgcagaaacttagcttacccctttttgactatttacagccatggcaatttttacttggtttgttttactgcccaagccagtcttagaatttctcaaagcctcaacccaaatataaaatccttcaggaatgagacttagtacaaatatatgggcaatattataaattttaattagcctaatggcctccatagtcctatgacaacctttgcaatttttgctgaactctatgcaaggtatctctacccaagagataactgagaattcctttcttacttacttttgttacaagtaattcctcttttgtttttaaaactacacgtggctctcctaatttttacctcctgaatcaacaacatatttacttatatttgcctcattagaacctaacttgcatatacacataataactccaggtatattggagttattatgtagctccaatgtaataattagacaatttaagagacttctcatgtcttccaggagatcatgcttacctggaagtgtctgagaggacactgatctccctggatgggggttacaaaagttgaaaaagctatcaaaacttggttaataatgctgactgaaaagataaagccataaagccctagaagtataaccaactaatctaaaataattaatccaagtggttacaggtaacagcatagctttagattgcttaatggtacaccaagaaaaaaatatgacatattgctaacagtccctgatgaatgtggagggaaggttgactaacctatagtcaaactgaaagaaaagacaatttggctaatcaaaagtggactcagaaggacctttgagatctgacctcctggtcagaataaggaaatctttggtcatcaatctaaagtgacttccagtgtctccttatcatcattctggttattcttgtctcacagtcttctaatgcctggtctccagagctgtatatgccactgcatagctgttatttcactgatggcacaaaaaattattttgcaatggaacgaaaaataaagggattctgatattcagtcaggccaaatgccaagcccttcagttagaattcctacaaaggtaataagccatacagcagtgaatacgtaatcatctgctctacttctacaggactaagggatggtgaaaataggggaggggattgttaaaactctgccaggttcccagtctgtgcactcaaaagtgttgaccctatgtccctgagcttaacattcatatcctgtctcagacctctttgttaagcaatgtctgtgcttttgtgacaaaagcagaaaaaataaaataaaataaaataaaataaaatggagaatttcgagtccccaaatgaaccaattagaacttaatgcctagaactggccaagcacagtggctcacgcctgtaatcgcagcacttcggaggccaaggtgggcagatcgcttcaggtcaggagttcgagaccaacctggtcaaaatggtgaacccgtatctctactaaaaatacaaaaattagccaggcatggtggcaggtgcctgtagtcccaactacttgggaggctgaggcaggagaatctcttgaacctgggaggcaaaggttgcagtgagctaagatggagccactgcagtccggcctgggcgacagaatgagactctgtctcaaaaaaaggaacttagtgcctagaatccttcccaacatgtaataagctttattttcttcttcatctatctctcccactttctgtgcggaaacactgaactcattacttaaccagcaagcagattgatttacatttatttatttaagctctggttgtgtttgtattattccttaaaggtatttataaaatattttattgaggcctggtgcggtggctcatgcctgtaatccccgcactttgggaggccaaggcaggcagatcatgaggtcaggagatctagagcatcctggctaacacagtgaaaccccgtctctactaaaaatacaaaaaaattagctgggcatggtggcatgcgcctgtagtcctagctacgtgggaggctgaggcaggacaacagtgtgaacccgggaggtggagcttgcagtgagccgagattgcgccactgcacctccagcctgggtgacagaacgagactccatctcaaaaaaaaaaaattttttttccaacaaatttgtttttgataagaaaatatctgataattattaattatctgcccccatccaatgcaagatggaagaagtagtactgaacattaatctagaaaattaagaatttttaaatatatccataagcttgtatgtttgacatcatgaagaaaaccacactattcctaaaatatattatactttatgtcataagcagagacagactattgcatgaataaaccaaacagaattagcttaccatagcttttttttgagacattttaaaagttattatttttatatttcatttactctcttgggtatctaagctagaattgatttactttcattacctttcaaattatcctcttgatttaggctttcagtgcagactggggaactagaaattccacagaaacaaatctcagaaaataaaattcccttagaatatgagtatcagaaaataatcttctaggtgtcatgacatcaaaagtttaaaaagttgatactttccacaatattttcatatagcagttctctagaaatgcttactggatgaatctacaatgaaccagagtgaaactgcctgttaccgagtaatatcccaatgggcatttggtctgtaaatacctaatatcccaatcaagtatctgctactagattaactgtaattgtaaggtactgcaactgggaggcataggggagtagattttttaaaagaaatgttccaaattatactttggcctaagtattcagccaaagtatgcttctccaattctgccttggcccatctcaagtcatttttggtatccctgaatgtcacatggtcagagattgcatgatcattcagttaccatcatatctaaacagggtaacaaaaatctggccaggcacagtgtcatgcctgtaagcccagcactttggaaggccaaagcgggcagatcgcttgagcccaggagctcaaaactagcctgggcaacatggcaaaaccccgtctctaccaaaaatgcaaaatttagccgggcgtggtggtgtgcgcccgtagtcccagctacttgggaggctgaggcaggacaatcgcccgaactcgggaggcggaggttgcagtgcgccgagattgcgccactgcactccagtctggacgacagagccaacctcgtttccaaaaaaaagtgagttgtgcactgggtcgccaagatgtcgttcccaaagtatactccttcacccctggccactatgccctcaaaccagccgaataggacatgtcttcggaaacccagcgggcgcaagccaagtgattgaccattaagagcctggctgaaacctgcttaccctaactgccgagggctcatcgaaaatcctgccttgattccttggacctatgcaagatcagcaagtgtctttcctaatttcagacccactcctaaaaactcactcttgggagctctgtgtggaattgggcccctcttcttctggtattatgttttcaaaactgacagggataggaaagaaaaacttatctgggaaggaaaattgggtccaacatttaacctgtcatattaagtctggcaatgatgactatgtattcttgcttaaataaatcgtctattaatcattaaacaaacaacaacaacagaaagtgagaattttttttttttttttgagacagagactcgctctgtctcccaggctggagtgcagtggtgcaatctgctcactgcagcctccgcctcctggattcaagcagttctcctgcctcagcctgccaagtagctgggattacaggcgcatgcgaccacacccagctaatttttgtatttttagtagagatggggtttcaccatgttagccaggctggtcttgaactactgacctcaggtgatccaccctcgaccttccacagtgctgagattacaggcgtgagccaccacacccggcccaagaatattttttcaagtatgtcatataggtgcagtggctcacgcctgtaattccagcactttgggagactgaggccagcagatcccttgagattgggagtttgagaccagcctggccaacatggtgagaccccgtctctaccaaaaaatacaaaaattagccgggcatggcgttgtgggcctgtagtcccagctactcaggaggctgaggcaggggaataatttgaacccgggaggcagaggttacagtgagccaagatcccaccgctgcactccagcctgggtgacagagttagatgccgtctcaaaaaaaaaaaaaaaatttactcttagtatctgaatattcattttccaattttaggtgttttacataaaacttggaatgaaaatctttttgtgtcactttgtatgttaaaattttctcaattagatgaagtataaatgtacattaatgcaagaagaaaatgtcacaatgattatgaatgctatttatgtacgaaagaaagtaacaattttcaaataggcaaataatagtgtaataatattgagagagttagctaatgaatttaagaatattaaatcctttttcagatgacaattataaaaactttaatgaaaaatacaaagcagaatagaaattttatatcataatttcaattgcattcagttgtcataccagtattaattatactaaacaaaatcatttctaaagactatgtttaatttttagttgttttataccatgaagtttttttcttccttttttttctgagactcaaaatccatgaatcttctatgagaaaatcttatttggggattcttcacatgtttttgtagataaattaaaagcagaatgttaactctaccacttcggaattttatgaggaggaaaacctccaaaagttcttacaacataatcatttttgctccagatattatatatgtgtatacatatttatatacatacacgtatatataaacacagacacatataaagacgttagaggaagaaagttcctccacctattttgtattccactaacttcagtggaaagtgaccctcaatttagtgtctgtatgtgcatgacagcaatcatagaaacaatctagcaacaggcagcactgagaaaattatcattactgcactataatgtcctactcttaaaataagattactaatatttctgagaataaattataataacttcagggataacatttcatatcttcacatatgccagaagtttactctatgatgatgataccgacttctgctccagctttaacaaatattggttttcacacttggccatttggcattcaaaaaagggatattttgtgcactaaatgtacagccaaaatatgtaggtaattcctatgtcaattcattatttcattccattttcatgtgcttatataaaatataattttaaaagaggatcttatatattccaaggatgtagaaaacaactcacagcctcccttatgggtctaacagaagatatcataaaaaactcaaccccacacagaagcaccagtgatctaataacattttattgttaactgccaataatcaagaaaaatccatgcaagaaaggtgttagttcttctgatctctatacattttcaatgaattcccttcacaggctgaaacttgtacacaatagaattgctttccatagctaaaaacttacagatctaagttagctagacttgacttcatagtctcttaaaatataaagattattaacatccttatacattaaaattttaatattttaagatttagacaagtgtcacgtaagatgaatttttaattaactaagatgaaattgtctgtgattcagtaatatccaaaataaaaacatttataaatgcccaaaatcccaatccagcaactgataccagagtaactatccttatgaagcaagggaaagatggctgaaactgaatgccacagataggctgtggttctcactcagctgcttagtcatcttagacaagttatttgcccttccaagtctgtttcctaaactataaaatgaatatattattatcttctctgtctaaatgttatagacatatatatataatatgaatattatatataaatatatatataatgaatatattattatcttctctgtctatatgtctaactaccaaatgaagttatggaaattacaaactctgatatatgtaaaatattgagtatcatgagggttccaaatctaggatctttattttcataccaactttatgaatagactgtgatcgatttttatgtagttttatgtttacttttaatgtttactctctttagaaactacttggaacttgattatttatttatttgccattcaagaatgtgagtatgatttatgaaaatgtattaacagttatctgaagtaataatgttaagctagaactcaaattacaaataaagaaaaacaaaacaaatataaaatcatttacaatagagaaagcttgctctttgccaagagtaataataatctgctgaaatcattattgttagtcacttaatgactactgtcttggttggtacacatcagcagcagtcaaataccacctcccagaacccaaccacccaaaaaaagatactgggaataagaatgtcctcagaaagctcaactgtaaaactaaaacataaaccagaacatagattaggaagtcaagcacggaggatcaagtaaaagataggactaaatttaagatactaacatgcaatgaaaagaaatatatctaccagaaatatggaggtgagtagtttggtcagcaatgaaagcagtgaaaaaggaaaggtacaaaacactatcacataagcattaaccaggagaaaggatatcctataaggcagattgatgtaagtaactgcttgacgagtatatcatggagctgagattatcactttatcagagtcgatgccatttaaaacttctagtcatttataatcaactcccttgttgttatctcatgatcttgttcagtaggcaactattgaaatttggttttccattcagcattctacagtgaaagaatacattccctgatgtaaatttctagtccttattttacttgaataaactggcgttctcttgtgatggggatgtatatgctcagataagaatgtgggctctggggatggaagctccggccgcggagtgatggtggcctcagcgaagatgggccgggcagggaccatggcagtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagcttcgagagctgtgcccaggagtgaacaaccagccctacctctgtgagagtggtcactgctgcagggagactggctgctgcacctactactatgagctctggtggttctggctgctctggactgtcctcatcctctttagctgctgttgggccttccgccaccgacgagctaaactcaggctgcaacaacagcagcggcagcgtgaaatcaacttgttggcctatcatggggcatgccatggggctggtcctttccctaccggttcactgcttgaccttcgcctcctcagcaccttcaagcccccagcctacgaggatgtggttcaccgcccaggcaccaccccccgccccccgcctccgcgccttatactgtcgccccaggccgccccttgactgcttccagtgaacaaacctgctgttcctcctcatccagctgccctgcccattttgaaggaacaaatgtggaaggtgtttcctcccaccagagtgccctccctcatcaggagggtgagcctggggcaggggtgacccctgcccccacacccccctcctgccgctatcgccgtttaactggcgactccggtattaagctctgcccttgtcctgcctccggtgagggtgagccagtcaaggaggtgagggttagtgccaccctgccagatctggaggactactccccgtgtgcactgcccccagattctgtaccgcaggtctttcccatggggctgtcttccagtgaaggggacatcccatacgtagttttgagagggtggatgggttacttgcccaccagaaacagccctagtcccaactccttgcgttccttttggcccctccctgcctacctagaatctgcctgaaagggctggagccctgaggagaggggcagtattgggggactgtgctagctttacccccgcaagacatacacaggagcctttgatctcattaaagagacgtgaaccagctaaaaaaaaaaaaaaaaaagagtgtgggctctggagtcaggttactttgagttcctactgacttactttgtgatcttgggaaatttaccaatctgttgtctgtttcctcatctgtagaaagggcgcctaataataggacctatttcccagggttgttgtgaggattaaacaattcatgtaaagcacttaaaacagtacgtgtcacatagcaagtgctaaacaaatgctagcctggttattatttttgaacatgaattaacattcctgtgtctgatcgctctgacactgatcagtttctaaatctaaaaaactgaagcagggtcactgtgtttcacaactccgggggcatcaatgcacaagagaacagagttctccggccgctctgaactgatggcatgacctggtgaattcaaggtcacccacctgtgaggttctttttgttagccaatctgtccaggtgaaaacttaagagtcataaacctaaaatgtctaccctagtgaggcagatctcctaaataagtgaggcacagcttgagtggtgagtttgccaagaaactatgaacgataagactgtggagcgtagagcacaagtcaagccttaaatgctttcaaatacagatattttaagatattctgtcaggcaaaaacaacagtataggcagattttaggcctgaagcccaccagtttgcaaaccctgcagcaccctttcattcaaaccttaaaatattttaacttaggataatgtacatcctgtgacctatttttaacctttatttttctttactgctctgtgactatcccttcttttctcctcccttggtttacaaaaacttctgtgctcttctccatacctcttgacacacataccttgagtggtatcattcatttcaactaacatttcaatcagctaaaaattccagatatttatatccaactctatcaatgctaagaaatacctcatgaatggtgcctgtctactttctcattgccaatgcctttggtcaagtcctcatctgatttctagacgtttacaatagctttggttcattctattctctcattgtccacatccagccaccactaaatcctactggttctaacaccaatcaaaccatatccacaatccaaccattttcacctaaaccatcatcatctgttacctaaattaccacagcagttccttttactattcatttacctcatttaccatactactcatttaccatataccatagaggatcctgtccctcctctgtttaatcccccattagctcccaggtcactcaagagtgaaatccaaggtccacacaatggcttacaaggccctatacaattgcctattacccctctaatttattctcttattattctctggccacatcccttgtgttttcctcaatcataccaggctcattcctggtccaggctttctctacctcccactccctttatatggatgctctttcctcaaatgtcttgggtctggattgttgtcttgtatcagggctctttgctcaaatgttactctttcataagtgcttccctaaacaccctccccacatgcacttgactccccatctccctttctgctttatcaccattgaacacatctgtttttcatgtttattttctgtctctcccaagaaaatgtaagtttcattacagcaagtttttttctttattgctgtattcctgatcttagaacaatatgtattaagcttcatgtttaatgaaaatgactgaaaagcttcctaacttgtcttccttctactgatctccccttctgtagtccacttcctcctatcccccaggtagtataccaaaaaatgcatctgatcattctcctgcttaaaagactttgatgggatccccacatccttcggggtctggccccaaatttaatctgtttccccattccccaaaatagttgtacactctccacatactaacacttttatcatccctgaacctacttgtgccatttatccatgcttttcgtgtatctctgtatttacttggccaaagttttattcatcctccaggtctagttatgccatgatgtctcccagaagccttcatctgtgtacccccacagcactcagttcaggcctccattatagtacttgtgctatactatgtatttaccaatctgcttctgcaactagattataagatcccagagagcaagttcatgatgttgtgtccagagttcttttgccagtgcttaacactatacttagcagagaggaaacactgcaagtctgaagaatgaaaatgtaatgaatgaaattttataatgaatgaaataatttgtttatgagaggttgggggaaaaaaagagtcttcctaagagtcagagtgctttacaacatcaaacctgagacctgatatgagtttttacatttgctaaagaaaaatttcctttagtaatttcaacaatagttaaattagtggattcaggaatcagaagtaagttaatggctagtcaggaaaggtatttactccacggaacataccaatttacacaccagatattgtgtggagcaaaaagtgtactccaatctgagaaaaggcatctgcaatttttttaattaaaattgatttaagtgggaaggaaaattgaaaattatctagtgcaactacttcatttcacaaatgaaaaaaatcatgaaaaggggaagagcattaacccaagttagaagatcaggatcagtaccaaggttttattcaaaatgaagggctctctctcaaatgtaacacattacagttccaaactactcaaggattaaagcccagaacttattccattactttgctgtgcaaacttaatgaagagtgaagataatattgcaagtaggaaaataatattgcaagactgaaaataataatacctgggttcttatctaggttgtatttgtgagatctcagacaattcactgaaccttgtaatgctaccttaattaactaccacatgggattaatgtgagaatcaaatgaaagccctgttgcaaatgaaaagtataatcatcttttccatcctcatcctttcaggttctccagtgcagtctcttagcaagttttcaatctatatggggggccataaaccacttgcaattctgactagttggagttttgttgttcttgtagtacaggacagaaagctgcgagggaagggtggggaggttgtttatgtattataaacctcctcccaaaggggagtattatccatatcacctatcaattaaagactctttgagactcacaagctcttaaaaggttcatgttgaaaaattatctttttccccagtacacgccctacaaaaccttttaccatttgtatatttcagaagattctgtaacaattacttgggttatatttatcttttcctactctactacagatgtgtccaaagcagggactcatagtatttcatcttcaggagctgtgaattgttttaattgggtcaacatccagttgaaatataaaactaagtggctggagtcgtgcctgagagaactgaatgaaaaagaactgaacgacgagagaccagaattatacctccctctgatttcccccaactctttcccctctatgtctattatatattgctaaagacctttagaaactaggctctgggcttatgcaaaagtcctctactacattctacatagccacaagtttatttacaagtatttttatattaataacattttataaaatacaatgttttaactccaggtgtgaaaatatttaaaggaaagtacactaaatggatttttttaattattcatctggcaaacaatcttgtgcaaaatggtcactatataacatgtacaaggccaggcgtggtggctcatgcctgtaatcccaacactctgggaggctgaaatgggaggatggctggagcccaggagttcgagaccagcctaggcatacagcgagactctatttctttaaacgagaaaaaaattatgcattctgtgaattccatttacatttagaatctcattctcataaacagtaatattttaatttgtattaaatcaaagcaattgtaaatataaatcataggcttcattttttttcctgtatacacaatatgccttaatttttgaaaatgttataaaaagaatatccttggctgggcacagtggctcacgcctgtaatcccaaaactttgggaggccaaggctggtggatcacttgaggttaggagttcaagaccagcctgtccaacatggtgaaacgtggtctctactaaaaatacaaaaaattagccaggtgtggtggcgggtgcctgtaatcccagctactcgggaggctgaggcaggagaatggtgtgaacctgggaggtggagcttgcagtgagctgagatcatgccactgcactacagcctgggcaacagagcaagactccatctcaaaaataaaataaaataaaataaaaaactgatacattggataactaaaataaaaaattctgctcatcaaagacactgttaaagccacattctaagggaaaatatggtcaagaactcacgtctagaacatgtaagaacttcaccagcttacatattttttaaaatctaatttacaagttgataaagatttgaacagaaacttcacaaaaatatacataagcagctaatgagcacatgaaagagtgtttaacatcctccaacctcagcctccaagtagctaggactacaggttatgcgccatcatgcctggctaattttcaaatttttttggtagacaactggtcttactatataatatgttgcccaggctggtctcctgggctgaagcagtcctcctgcccctacccctcaaagtgctgtgattacaggcgtgaattttcatttaaaagaaattaaattaaaagaaattaaaattacagatgtgaattttaatttaaaagaaattaaattaaattaaaagaaattaaaattcatgcctgtaatcgaagcactttgggagataggggcaggaggactgcttgagcccaggagtttgagaccagcctgggcaacatattatagtaagaccttgtctctgccaaaaaaatttaaaaattagccaggcatgatgaagcataccagtaatcctagccacttggaggctgaggtaggaggatggcttgagcctatgagttcgagattacagccaactacgatagcatcactgcagtccggcgtaggcaaaaagtgacaccccgtctcttaaaaaaaaaaaagaaatgaaaatgtatgtccacgggccgggcatggtggctcacacctgtaatctcagcactttgggaggtcaacatgggcggattattgaggccaggagtttgagaccaggctggccaacatggcaaaatccagtctctactaaaaatacaaaaattagccaggcatggtggcgcatacctgtaattctagctactggggaggctgaggcatgagaactgcctgaactcgggagtcagaggttgcagtgagccgagatcgtgccactgcactccagcctggatgacacagcaagactctgtccccctcccccaaaaaaagaaaatatatatccacaaagacttgccagtgaattttggcagtagcttgctttattcatgacttaaaaaaaaaaaatggaaatagcctagatatctaccagcagaagaaggatggataaacaaactatggtatattcatactactcagcaataaaaaagcacaaactacgggtatctgtaacaatatgaatgaatctcaaaagcattatgctgaataaatcttataccaaagattacatactatattattttatttacatcaagttctagaacaggcataactaagatatggtgacagaattcagatcagtgattgctagaagaagagaataaagctgattaaaaacagcaagaggggccaggcccagtggctcatgcctgtaatcccagaactttgggaggccgaggtgggcagatcacgaggtcaggagttcaagaccagcctgaccaacatggtgaaaccctatctctactaaaaatacaaaaattggccaggcgtggtggcgcatgcctataatcccagctattcaggaggttgaggcaggagaatagcttcaacccaggaggtggtgagccaacatcgtgccactgcactccagcctaggcgataaggcgagactccgtctcaaaaaaaaaaaaccacacaaggaaattttatggagttataaaaatattctgtgtctatataggagtgtaggttacatgagtgtgcatatattaaaactgatcaaactgtaaactcaagatgtatttcatttttgtaaattacaccacaatttaaaaaaacatatttggaccacttaagaataataccatggaggccaggtgcagtggctcatgcctgtaatcccagcactttgggacaccaaggtcaggaaggtcacttgaggtcaggagttcgagaccagcctggccaacatggtgaaaccctgtctctaccaaaactacaaaaattagccgggcatggtggcgggcgcctgtaatcccagctattcaggaggctgagacaggagaactgcttgaacctgggaggcggagattgcagtgagctcagatcgtgccactgcactccctcccgggcaacaagagcgatactccgtctcaaaaaaaaaaaaaaaaaaaaaaggaatataccatggaacctgatacgattgagaaccttaatttaaaaaacactgcataaaaaaggtaaatgctgtcatttcaggtgatcagttgataataaaatgtctacaaacccaaactgaaatcatgcagtaatacatacattaatttttggataatcattaaagaccatagaaaatgtaacagatcctactcttcaaaataattgctattcagtattaaaataaataaagtgaaaggtgttggaaagatagaggaattgataggaataccacagaagtggaagaatagtatgaatatccataaattaatttatattagcaagaaataataatgcttacatcatcagatccagtctcagaaggccttgcttttttgggtgcaatgacaggggaaagtgatccttcaaagtcaaactgaaaagtaaccccaaaagaaaagataaaaatcataaatgcattcctgtcaactgatcaacttaaaggattcagaaatcagttctgccaattatgaaaactgagaaaagccatcaaaactcattttttgatctggaaagtcattatttaaatatctttcttccaggttactgtaaagatgaaatgaaatcatattaatatatgcaaacatctagaacagtgcctgggctcctaaggactgattttaatggtagtttccttccctctcctacttctgtaacaacatagattacatcacatctttggtagaaaaagaaactttaggcatatccacaatataccaagtctcaaaggatcaacccaatatcagtcaaatgttagaactaagcaaacatttatttacagtccacctacagtaaactatctaacaattctatggcagagacaagtagctactctggaaaatcttttttctcctctttctactgaacccacagccagactacatacatacgtctgcctcctttgaagttaggtgtgaccctttgacagagttaattataaatggaagtcactgtcatcacttccaggaccagtccagtcctacccctgctcctccaggctctttgccccttccacctgactggaatgcagtcaaccaacggcaagctttgaaccgaagacaaaagatcctccatcaacctgggttcctgaataactgtgtggcctgtttatctgctaagccctgttatgtaaacaagacagacatttttattgtgtttgagccattgtatcttttgaggcctttctattacaatagtgagcctatcttttaactagtacaactacatcaaagcagttttctgcaagttgctcttcttcaatttcccctggcataatctttgctgccccagctacttcacatgggcattgaccatcaactaataaactgtaactctataaatggcaatggctattttcctatgctgaaaaacttacatatttatcaactcactcacctaaacagagttgatttctatataaaaactaaacataggtagcaataaagtgatttttaaaaccgaatgttattgagagagaagatttgcttgtgaagcattcaaataaaaaacagcccaactcatatatattataaaaaacctggtagtaacagtgaaatcaaagcaacaaatataacagtaactatctaacctaaaacttcaaccaaaatgtaacacacacaaagtcccacagtcaaaaagaatgtccctgctataattatcagattcataaggcctggagttatgagaaagtagaaactgcctgataaggatggctctttgtgccatacatggatctgtttaatcttcactctttcaatgtgtctcaggttagccaaccctgttatatgctcctatggacccttacccttcatctatcataacacatgtatcaaatattacttatttgtttccctcaagacagtcaattccagaggaacaatctgttttgtttggggtatatgtgagaaacctggcatcatgcctggcccacagcagggattcaatatttatctaatgaaaaaaagagcagcccaaaagccacaaaaagttaaccccaaatgcaactgttcctacaatgtacagtccagtgcactcatgtaacacatcagcaaattaaagaaagcacaaagaaatgccaaaaattgtgtaacgagtcattggcagaaattctgtactccaccacattatatatgtgaaaacaaaaagaataaatctgaacaaagcaaaatgaaaaccatttgccaatgaggaccatttcatcctaagctttgactatgaggacaaaagatagcaagggtttaaccacgcagtcctataaataaatggcaaagcaacttggcctcaagaattgatttccttattccttcctttataattatcatgcaataagtaagtcaaagagtcatgtccttctttgcaaaggaaaaaatgggtaggtgctcagtcctccccaaaacatggaaacgcgagggggcataggttctctgccagagactaggacacaacaatctgtactcatcaacaagttccaaggacaatgatacacaaaactacagaaagctgacatgctttttcataatgtagaaatccagtttctatgaggcttaatcttttcacatgtaataaagaacagaaaaattgaggataatgtcacttggatacaattgtttaaaattagaaaagaaggccaggagccatggttcacacctgtaatcctagcactttgggaggccaaggtgggaggatcacttgagctcaggagtttgaaaccagcatagcccacatggcaaaaccccgtctctactaaaaatacagaaattagccaggcgtggaagtgcatgcctgtaatcccagctactcgggaggctgaggcacaagaatcgctccaacttaggaggcagaggttgtagtgagccaggatagcgccactgcattccagcctagatgacagagcaaaaccccgtcttaaaaaaggaaagaaaggaaaagaaaattgtccctattttcccataagatttttctcaaggaaattgcagacagcaattccttcatgtgctgaaatagacacaaactcttaaaaacagtatctcactcagatggaaaatggcattcactcaacaaatgttcactgagtatccttctatgccaggcaataccacaggtcctggagagagagagtagtaaacaaaactaagcaaaaatctttgccttcctagaatttacattccagttgggggaggagggacacaaaacaaaataagtaaaacatacagtatattatatttaattaagtgagaagaaagaaaaacaggtaaatggcactaaaggtatggaggcaggtgtaattctatagagagagacaggacaggcagcactgaggtgacatctgaataaagacctaagcacgtcttgtcggagggaaagcattctccatagaggtaatggcaagtgcaaacactcagaggcagaaacatgctggcagtgctcagggaacagagctgaggccaatgtggctgggatgatgcgtgcaaagcattaagaaataagaccaggaaggtgagcaagggctaggtcacatggcatcttataagcctatggcctttactctgagtgacatgggaagtcactgggggattctacgcagaggcgtgacgaacgcaacctgacgttatcaaacaggattactttggccactggtctgagaagagactggaacatagacaaaggacatgaaatatgaataaaaaaataagaactataaataactgatgaaaatttgaaaaaaccattcccatttacttatagagaaataagataaaatttctcaggaagctggcaaaggttcaccacaccacaaataaacactgtggtgaaatgggcgcttttaaatgatgctagtaagaatggcaccggcgaacccctttccaaacattacttgacctcacagtttctcttttaagattcaattcttgggaagtaactagagatgtggttaaagagtcgtgaaaaaggatgtttataaattacaataacgaaaacaacagattcacaaggtacaattattagctattggttaattatgataaaactacactatgaagaaatgatggagatattttagaaaaaatttttaatgataacgggaaattttcattggtatttttatatagaaggtaacatcaaaaatatttagagtggttatctctgagtagtataattattttcttaattcctccattttccacattttcctttcataattaagacaaaaaacaagttttaaaaatggatttgctggccaggcacggtggctcacacctgtaatcccagcactttgggaggctgagacgggcagatcacgaggtcaggagatcgagaccatcctggctaacatggtgaaaccccatctctactaaaaatacaaaaaattagccgggcgtggtggcgggcgcctgtagtcccagctactcgggaggctgaggcaggaaaatggcatgaacccaggaggcagagcctgtagtgagctgagattgtgccattgcactccagcctaggcgacagagcaacattctgtctcaaaaaaaaaaaaaaaaaaaaaggatttggtgtgcaaggctaaaacatatagaatggtacagctgagctacctggaaaaggggtaattacagtctagagtgattttttttcagagtgacccaggcaaagttgtcctgggagtgatctccaaagctagaaggagatcaccaatactgaggacaccactctgctgattttgtaaataatctaataagggcctgtaaggatgttactgggggaagagggtgagaggtaaggccttataccattaacagagtagatggtataagtacagagtagatggtatagtactcggctaaagtactttaaatctccctcaaatcaaaccttcctcttcacatcccaagcaatatgtgtgtaaaaagacaatcttatcttcagaaaacaatgttaaacaaggagtcagaagatgcagtctagtcatagtttttaaaaaatcacagatctgtgatttctttgtgatccagtttcttcatcaataaaaccaagactatcactaatcctagcataacttgcagtcattttacaaaggtgaaatgagaaatagtcatatatgctttaacattctaaagctcagtaattataatcactagtaaaatgttaatattaaatattaagtgagatttgatttacaacatatagatacaataaaccttaatatcattctattattttgaatatggtacgcctattatgtagtctcaatgttatattaccaattatgcaaccattacattaacagaataactcataaagaaaacaattgtatttacttacatttctagtccatgctaagcggtctgtgttaaaacccatcacgttcatgagacaagtcacaaat

SEQ ID NO: 1531 - DNA, 19436 bp, Homo sapiens
caggaccgctggcgccagcgggagaaccaggaagcgcagctctccccttagctgactctggtgctctctacaggtggccttcactatcaactgcacagcgggcagaggcagaggaacacagaaccttctcacacagcgggataaaagggtgaatttggagctgacaggcaaatatatcttgtgatatatttctctggctttgatatcagggtaatattggccgcatagaatgaagtagtgttcctccgttattttttggaagacattgctaagtactggtattatttcttccttaaatgtttgatagaatttgcacgcgaagccatcttggcttggcttgtatttctggggagattttaaattactaattaaatctcttttcatgctatagtcctaagtcgattttctacttattatttatttatttatttattcatttattttgagacggagtttcactcttgttgttcgctcttgttgcccggggtggagtgcaatggcatgatcttggctcacccaacctccgcctcccgggttcaagtgattctcctgcctcagcctcccaaatagctgggattacaggcatgcgccaccacgcccagctaattttgtatttgtagtagagacggagtttctccatgtttgtcaggctggtctcaaactcccaacctcaggtgatccgcccgccttggcctcccaaagtgctgggattacaggcgtgagccactgcacccagcctgtttcttcttgagtcggtaatttgtcttccaagaattttttccattttacctaagttgtttagtttgttggcgtaaagttgttcataatgtattccttttaatttctgtaaggtcagtattaataacccccctttcatttttgattttgataatctgtgtagtcctttctatttttcttggtcagtcaagctaaaagattgttagattttttttttcaccttttcggtgaaccaacttttgatttcattgatttttctgtttcttatttcattgattttcttctactctaattttcatcattcccctccttctgcttgcttgtattaaatacatcagtttaaaacttcaggaataacaaaagatttgtttcgcaaaggaagatttgaaatgttagacatgtagaaatgcttatgatattgcaagtagcagtcatttcgaccagttaaccagaaggaaattcggtgtgctgaaaccaaacaagtgtttttttgtgccgggcttttactgattttgaaaatatcaagtctagtttgtgggaagctgtttattgcatgagcagtttatttttttaatgttttaatatagagaatgcccatgttcactaaatcccacaagtttgtttgtttgtttgtttgtttgtttgttttttaacttaaaggaaagtatgtattaaccagcacatacactatcctctttgtgctttatctctggtaatccttataagagcaccatgagttagatactgttttatgccctttttatggaaatagaatcttagagtgtacatttaagtagctctcccaggtataaccagctggaaaagtgacagaacctaggtctctcagattccagagattgcacacacgaatactatatcacactgcttactgctgtgagttcagcagagaattccttgtttatatggaaataacaaaattgatagtatccaggataattggcaacagtttacaaaccctctttacccccactttggtgattttaagtggggtcatctgtccactaaattaaacagatcttaggctggtcacacttctaaaattgtacaccaagtttgtgtgtaaaggtactttcccagggaaaaatatctgtagatttaatcaaattatccaaagagggttaggcccactacccagtgttccctggatgataagagaatgccatggagcctacacccttccagtgggaagaatagtgccaatttacttgccatttatgttctagtttttaatcagagtgttccagtcacacacacatagttagctatgaggaatatctgcagatgctggttcctccacttcaaacgagtcagctaactctaggtgaagagctttatactttggactatgtggttataaatgatgggcaggtaggataactagaacagtgtatatgctcattaatacatacttatcctttaagtctgaaaaaatgaacttgtggaattcagtgaaaattggcattctaaatattaaagtattaatatttagaattatagatttttagttgggatggtggtataaggaaggtcagcccattctcaaactgggttggaggcataagggacttgtttaacctaacctagtggtgtgaacctacaggaagtagtgatggtggactgagtcatgacttaggtaaagggagatgattctagatcatggaacatgatatagattctagacatgagattctaaactctggtaccaaggcacacattgctaagacaatctgtgatcatgtactctcaagaggatcatatatttcagctgtatagcgccaatttatgtgccagttacgttccagttataaatcaaagtgttctagtaacacacatagttaattatgaggactatctgcagatgcaggcttctccacttcaaacgagtcaaccaactccacctgaagaacttcatgctgctgcctatgtgtttacaaatgatgggcaggtaagataactctttctatttctgccctaattgtgacattcttcgtataattattttctcattggaaagatgaatataaactatatgtgttaattctcttgatttaaaagataaaatatgacacaggaaatcttatgtgaacataaaatgggaactttttgatccaagagtggattggttgtactaggaactgatttattttattttattttattttattttatttatatctttttttttttttttgagatggagtttcactcttgttgcccaggctggagtgcaatggcacgatctcagctcaccgcaacctccacttcccgggttcaagtgattctcctgccttagccttctgagtagctgggattacaggcatgcgccaccacacccagcttattttttgtatttttagtagagacagggtttctccattttggacaggctgctctcgaactcccgacctcaggtgatccgcccacctcgcctcccaaagtgctgggattacaggcatgagccaccgcacctggccgaactgatgtttttaattatcacatttaatgctcatagttgttctgcagatatgtattactatctaccctttaataagaaatcaaggctgacagtggtcaaatggcttgccccatgtgacacaagataggaggtagagccagggtttgaacgcatatctttctgactccagagtctatattctttcccactccccacaataactcctttaatatcgagattgcagtctacagtctctctttctgttatccaagtcactagtgctctgcctaaaaaaatgactaagtattcctcgtggaatatgaagcactaggtgatgttgccatgattggattgtcctgatggagatcttaatgtgagttttgtgttgtgtatgagagagacttactaacttcaccattagaacatgaagacaaaggagattgcatctgcactaggacacaattaggcaataatctcttctgtaacaaaaccagactaaagttattccaccacattcccaaaactcctcaattaattaggcttttccttaattttctgtgcctttattttctcttttttaacaatagtcataagaatcacacctcactcatagggattggccaaggattgagttaatacatgtaaagcattgagaacagtacctggagggtagtaaatgttcagtaaaaatgttttcacacattctccactctgcttttataggaaatgaaaatggtttggaaaattttttaatcaaaattatatatttgaatataattttcattaaatatgctcctgcatatttaatgcaagagcatattctttatttcttcaacttttactttaagtcctggggtacatgtgcaggatgtgcaggtttattacataggtaaacgtgtggcatggtggcttactgcacctatgaacccatcaccttggtattaagcccagcacccagtagctatttttcctgatgcattccctcccccaactcctcccccaacaggcccagtgtgtgttgccctgcccgacgtgtccatgtgttctcatcattcagctcccacttataagtgagaacacgtgctgtttggttttcttttcttgcgttagtttcctgatgataacggcttctagctccatccatgtttctgcaaaggacatgatctcattccttttttattttttttcttttttttgagacggagtcacgctctgtcgcccaggctggagtgcagtggcatgatctcggctcactgcaagctccgcctcccgggctcatgccattctcctgcctcagcctcccgagtagctggtactgcaagcgcccgccaccacacctggctaattttttttgtatttttagtagagacggggtttcaccgtgttagccaggatggtctccatctcctgacctcgtgatccgcccgccttggcctcccaaagtgctgggattacaggcgtgagccaccgcacccggccgatctcattcctttttatggctgcatagtattccgtggtgtatatgtactacattttctttatccagtctatcattgatgggcatttgggttgattccacatctttgctattgtgaatagtgctgcaatgaacatacatgtgcatgtatctttataatagaatgatttatatttctctgggtatatacccagtaatgagattgctggatcaaatgatatttctgcctctagatctttcaggaatcaccacactgtcatccacatggttgaagtaatttacactcccaccaacagtgtaaaagcagtcctttttctccacagccttgccagcatctgtagttttttgacgttttagtaatcgccattctgactggcatgagatgttatctcattgtggtttcgagttgcatttctctaatgatcagtgatgttgagctttttttcatatttttgttgcccgcgtgaatatcttcttttgagacgtgtctgttcatgtcctttgcccactttttaatggggttgtttggttttcttttgtaaatttgtttaagtttcttgtagactctggatagtagacctttgtcagatgggcagattgcaaaagttttctcccattctgtaggctgtctattcactctgatgatagtttattttgctatgcatatgctctttagtttaattagatcccatttgtcaacttttgcttttgttgccattgcttttggcatttttgtcatgaaatctttgccggtgcctatgtcctgaatagtattgcctatttttttttctagggtttgtatagttttgtgttctacatttaagtctttaatccatcttgagtaaatttttgtataaggtgtaaggaaggagcccagtttcaaattttgcatacagctagccagttctcccagcaccattaattaaatagggaatcctgtccccattgcttgtttttgtcaggtttgtcgaagatcagataattatcactgtgtgatcttatttccgagttctctattctgttccattggtccatgtatctgtttttctgccagcaccatgctgctttggttactgtagccctgtagtatagtttgaagttaggtagcgtgatgcctccagctttgttcttattgcttaggattgtcttggctattctggctcttttttcgttccatatgcattttaaaatagctccttctaacttggtgaagaatatcaatgatagtttaatggaaatagcattgaatttctaaattactttgggcagtatggccattttcacaatattgattcttcctatccatgagcatggaatgtttttccattcatttatttgctctctgatttccttgagcagtggtttgtagttctctctgaagaggtctttcacttcccttgttagccatattcctaggtaatttattctttttgtaggaattgttaatgggagttcattcatgatttgtctctctgcttgcctgtttttggtgtagaggaatgctagcaatttttgcacatggattttgtatcccgagactttgctgaaattgcttatcagcttaagaagcttttgggctgagacaacgggattttctagatatagggtcatgtcatctgcaaacaaaggtaatttgacttcctttctccctttttgaatactctttatttctttgccttgcccgattcccctggacagaacgtgtaatactatgttgaataggcgaggtgagggagggcatccttgttttgtgccagtttcaagggtaatgcttccaggtttttcccattcagtatgatattggctgtgggtttgtcatatatggctcttattattttgaggtatgttccttcaatacctggtttattgagagcttttaatataaggggatgttgaattttatcaaaggccttttctgcatctattgagataagcgtgtggtttttgtctttagttctgtttatgtgatgaattacattcattgattggcctattctgaaatgaccttgcatcccggggatgaagccaacttgatcatggggaataagctttttgatgtgctgctggattcagttttccagtattttattgaggattttgcatcgatgttcatcaggaatactggcctgaagtttttttttgttgtatctctgccaggttttggtatcagggtgatgctggtctcataaaatgagttaggtaggagtccctcctttttaattttttggaatagtttcggtagtaatattaccagctcttcttggtacctctagtaggcaggaacatattcttgggttatcctttgatgaaaacagcttttagttaacatacatactatacccttcattttcatgttttatttaccactaacattgtaaagctcgccctacccctacctgattccaagatcaacatatcggaatctccataaggttggaggtgggaaaatttatcttttcaatctatcctacccttcattatctatatgtatcatctaataaagtattaatgattattggttaataagtaactttaaagcactaaaagaggccgggtgtggtggctcgcacctgtaatcccagcactttgggaggccgaggtgggaggatcaggaggtcaggagatcaagaccatcctggctaacacggtgaaaccccatctctactaaaaatacaaaatagccgggcgtggtggcgggtgcctgtagtcccaggaactcgggaagctgaggcagtagaatggcgtgacttggggaagcagagcttgcagtgagccgagatcatgcaattgcaatccagcctgggcgacagagcaagactccgtctaaaaaaaaaaaaaaaaaaaaaaagcactaaaagataaaaaaggtatttctttttttttctcccctaacaagggctgagacaaaatgatgtgtacttcatgagagagataaccatatgtttatacctttggatgatgaaagccactcattccccaagcattctgatttatcatgactgtaccatgtttgactttggataacaccttgtattttaccttcccttgtttcactgagacttgactaaaattagcttgccttttctgagagcatcgtgtatgttcagggatgagaaatctttgacctgtgactaaaacttacattaatgatataaatgcatggctgtgtatgcatatgaagactgtgactttgcagtggttggatttgtctttaatggaatatgttcactgatgtttttcagcaaatgaggagtgatgaagtaaatctggttgcaacagggcatcaaagcaaaaagaaacattccagaaaatccaagagacactcttcatctaagagaaggaagagtatgtcctcgtggttagacaaacaggaaggtgagggggaatccaatctttgggcctcaaccatgtcaaaggacatttgtagtcatgtccttgagggatgaacagatatgagcacatttgcaagtggaagggcaaggttctaattaggtgcaacaatttggagttgttgcaagcgttagatgaatgaagcaggttcctgaggcagaaggagatggtgggctcaacaagaggatgggtctgctcactttctgcctgtcctcacattccgctctaacccagtgtggtctggcttcttagtgtactccaatgaaactactatcatcaaggtcaccagtgtttgctacactttggcgttaatgtctcagcagcatgcgacacagttgtttactccctcctgcacggaaagcttcttgggtccccagacacctggatttcttaccctgttactagagactcattttccttctcttttttgtttttctcctctcccttcccacctctaaatatttcggaaccccaaagcttaatcctagactctcttctcttcagtatactatctatttaggcgatgccgtgctgtcttagaattttaaatgattcacactataagaactctcaccattatacttctacactacaacttgctcctgaaatccagactcaaatacgactacactcgcggtatctttactgggtgtctaataggcatgtaaaattcaactgactctacatgctcaaatttctgacctccctctctccaaaaatactctacttttagctttcactatttcaattaaagatactgtccattaggtgaaacatccacaaaggtgtaacaaccagctgttcacaggtatgggggattgaggaatcctggtttttacagtttgcagctatccatcgggcaaataatcccaccatggcctagttcaagctgtcaacataaggtcactgaaccagattcaggaagagttggcagcactcagctctcatggtcggttgcctaacacctcctgaacacccctggtgtacttttacttagtagttctagtcaaaatacttaaagtcacttatgagttatctcatgattcttttattactctctcatttcccatttcttagcaagtccagcagtagatgcccagtataaattctgcatccaaccatttctctctatgcctccagtgcatgctgccgtgatctgtctccaggctagtacaatgccttcttagctctgtgtttctaatcttcgctcatctatcgcatactctctaaccctgtggctagataattatttcagcacgtaaatcacatcatgccatgtccctcctgaaaacccatcctcatctctcctaagcactcagaacagaccctgaaccggctttggtctccaagcctctgcacagcctggcctctgtcaccctctcctaacatgggtcccatccatttcctcctggctctctctgcctctgaccttcacctctgtagtgcccggtccatccccactccattccctacccttggcctcactgcagcctggaactctccctctgcctctgcacaggaggctctgcttctttctccaagccctgcccaatggcacttcttcagaagcctctgccaaaccagctgcagccccaggggctccctctgctgctgtctcccacaggcctgtggactgcttttccaacaccagcccaatgctgcttgtttcatttgctcattgtgcatgtactgtctgactgccccatgaggatgtgagctccacaagggcagggaacgttgctccctgggctgtttactgctgatccctgggtcctggcatgctgcctgccacagatgatgaataaatgaaagaggcgtcagacctggagtgaaaagaaagtcactttttctagataaaagggaaggatctgtagaatcatataaaaatacagatgtgtgatgatggagtggtgataagagtgttcaactccaatagccacgtgtattttctcagagtatttggggtagaaaggaggcaggttaaggagggctcacttagtctggcttcctgctgtgcacagcatggcatttataggtgaactatacaaataatatcaagtgagaattatcatcttgctgcctatcaagggcagcaagatgatacaaaatgacgaatacaaaaacctgtgaatgtttattctgctgtcgtacttctttactgcatatattcattatgccaagaggtaaaaaggtagttttattgtattatctgacctgatctctgtcacaagatctgagatttccacgtggtaaatccttctgtttcatgaaataaataattctttagaacctgattaatacacagctgtccctctgggggaggatgggacaaaacacacctatcttgcagctcaacctcttcatttggtttccagctgctagcatcactcacaatgtccatgaagagaaggtaaaaaatggccaatctgcacacaataatgtcattgcaactgttccatcagtgcttattagtatggcagcagctggtatttcatccatgagtaccagggaccagtgtaaatttgctcacttgttatactgtcctacgaggattccactacgcaccatatatgcatagtgtcgtgagggaagaaggtaattttgttgtattatcttttctggcctcaattttagggttctcagattgctacctggtatatccttcttctttatgagataatttcctagatactgagcatcagtggggcatgcctgtgccattgacataatgcacttacctcacagctcaaccacttcatttggtttccagatgctgcagtcactcacagcatttgtgaagagaggataaataacggccaaccagtagctgataatgtcttgtcaactgctccaccatggcctggtaatatggcagcagcaggaatttcatccatgagtatgaaattcatccatgagtacttattaattgtactgtcctacttggtttccataagcaggcatattttcatgaattatagaaggtggttttgttgtatattctttcttagcctcaatttgaggggtatcagatggccagctggcatatcctcccctgcttttttagataatttcctagaaattgaacacagaggaatatacctgtggggttgacataatgcacttacctcacagctcaacctcttcacttggtttccacacgctactgtcaatcacagtgtccatgaggaggggatggaaaatggtcaaccccaacgagataatgtcatgtcaaatgttctatcagggcttattaatatgacaggagctggtattccagcgatgagtaccagggatctgtgtgtgtttgtttattagttgtagtgtcctccttggtttccatgtgcatgcataatgtcatgaagggaagaaggtggttttgttgaattatctttcgtgacctcaacttaagtggactcaaatcattatatgatgtattctcctgcattaggggataatttcctagaaaccgagcatcagtgggatatactggttcaattgtcataatgcacatacctcacaactcaacctgttccatcggtttccagatgctaccatcgctcacaatatccgtgaagagaggatggaaaatggccaatctcgaactgacaaagtcttgtcaactgctccaccacagcttgttcatatggctgcagctggtattccatccatgagtaccagggatctgcgtatgtctgctaattagttgtactgtcatacttgttttccataagcatggatattttcatgaaaggtagaagtcacttttgttgcatatactttcctagtctcaatttgaggggtctcagatggccacctggcaaatcctcccctgatttcctagataatttcctagaaactgagcatcagagggatatacctgttgggctgacatagtggacttacctcacagttcaaactcttcgtttgttttccagattcaactgttactcacattatctgtgaagagaagataaaaaatgaacaaatggcacctgataaattcttgtctactattacagcggggcttatgaatttcacaggggctgatattccacccctgagtaccagggatcagtgtgtgtttactagttgtactgacctacttgcttttcgtacgcatgcagtgtcatgcagggaagaaggtggtttcgttttattatcttttctggcctaaaattcaggggtctcaaatcaccacctgatatgtcctcctggtttatgggataatttcctagaaactgagcatcagagggatatacctgtggcactgacgtaatgcacttacctcacagcttgaactcttcatttggtttccagattctaccgtcactcacaatatccgtgaagagagaatggaaaatggccaaccccaacctgataacgtcttgtcaactggtcccacagggcttattaatatggcagcaactcctattccagccatgagtgccagagatctctgtatgtccacttataaattgtgctgtcttacttggttttcatatgcatacatagtgccatgaagggagttaggtggttttgttgtgttatcgtttctggcctaaatctgaggggtctcacatcaccacctgatatatcctactgctttatgaaataatttcatagaaactgagcaccagagggatatacttgtgagttggcataatgcacttacctcacagctcaacctcttcctttggtttccagatgctacagtcactcacaatgtctgtgaacagaagatggaaaatgtccaaccagcacctgataacgtgttgttgactcttcgaccacggcgtattaatatgacagacactggtatttcacccatgagtaccagggatccatgtaagtttgtttatttgtattactgtcctacttggtttccatatgcatgcatagtgtcaaaaagcatacaaggtggttttgttgtattgtcgttcctggtatttcacccatgagtaccagggatccatgtaagtttgtttatttgtattactgtcctacttggtttccatatgcatgcatagtgtcaaaaagcatacaaggtggttttgttgtattgtctttcctggcctcaatttcaggggtctcgtatggcaacctggtatatcctcctgtttatgagataatttcctagaaactgagcatcagagggatatacctgtggggttaccataatacacttacctaacagctcagcctcttcatttggtttccagatgctaccatcacttacaatgtccctgaggagaagatggaaaagggccaaccccaacctgataacatcttgtcaactgcttcaacagggcttattaatgtggcaggagctggtactccagccatcagcaccaatggcctgtgtatgtttgcttgttaattggattatcctgcttggtttccatatacgtgcatattgtcatgaaggggagatggaggttttgttgtatcatctatcttgagctcaatttgaggggtctcagatcaccacctgtcatgtcctcctgctttatgcaataatttcttagaagctgagcatcataggggtatacctgtggggctgacataatgcacttactcacagctcaacctcttcatttgttttccagattccaccgtccctcacaatgtctgtgaagagaagatggaaaatgaccaaccgcaacctaataacgtattgtcaactgttcaaccagtgattatttatttgacagcaactggtattccgggcatgaataccagggatcagtgtatgtttgtttactagttgtagtgtcctagttggtttacatatgaatgcacagtgtcataaagggaaggaggttgttttattggattctctttcatgagctcaatctgaggtgtctcagatcatcacttgctgtatcctcctgctttatgagttaatttcctagaccctgagcatcagagggatatacctgtagggctgacataatacacttagctcagagctcaagcttttcatttggtttccagatgctaccatcactcacaatgtctgtgaagagagagtggtaaataaccaaccactacctagtaacgccttgtcaactgttctaccagggcttgcttatttggcaacagctgatatgccagccatgagtaccagggatcagcgtaagtttgtttactagttgtggtgtcctacttggtttccatatgcatgcatattgtcatcaagggaagaagacggtattgttgtattatgttttctggcctcaattttagggttttcaattgctccctggtatatcctagttccttaggagataaattcctagatagtgagcatcagagggggtattcctgtgggattgacatactgcacttacctcacagctcatcaactacatttggtttccagatgctaccatcattcacaatctgcgtgaagagaagaaagataacagccaaccaacccctgataacgtcttgtcagctgttacaccagagcttattaacttggcaggagctggtattccacccatgagtaccagggatcagtgtatgtttgcttactagttgtactatcctacttggtttccatatgaatgcagtatcataaatggaagaatgtggttttattatattgtctttcgtgagttgaatttgtggggtctcagatcgctgcctggtatatcctcctgctttatgtgataaattcctagaaactgagcatcagagggatatatacatgtgtgcttggcataatgcacttaactcacagctcgacctctttatttggtttctagatgctaccgtcaatcaccatgtccatgaagcaaggatggaaaatggccaacgaaaacaggataacgtcttgtcaaatgttctatccgggcttattaatatggcaggagctagtattccagcaatgagttccagggatctgtgtatgtgtgttttttagttataccatcctccttgatttccatatgcatgcatagtgtcatgaagggaagaaggttgttttgtgaattatctttcctggcctcaatttgaggggcctcagatcatcatatgatgtattatcctgctttatgggataattttctaaaaattcatcatcagtgggatatatcggtggggttgacataatgcacgtacctcacagcttgacctctccctttggtttccagatgctaccattactcacagtgttcgtgaagagaagatggaaagtggcaaaccccaaactgataaggtcatatcaaatgatgcaccacagcttggtcatatggctgcaggtggtattccatccatgagtaccaaggatctgtgtatgtctgttaattagttgtactgtcatacttggtttacatatgcatgcatattttcatgaagggtagatgtggttttgtagtatattctttcctaacctcaatttgagggatctcagttgtccacatggcatatcctccccagctttcttagataatttcctagaaactgggtatcagaggaatatatctgcagggctgacataatgcacttacctcacagctcaacctcttcatgtggtttccagattttaccatcactcacaatgactgtgaagaaaagattaaaaattagcaaagagcacctgatacattattgtcaactgttacagcagggcttatgaatgtcacaggggctggtattccacccctgagtaccagggatcagtgtatgtttgtttactagtcgtactgtcctacttgacttccatacgcatgcagtgtcatgcagggaagaaggtggtttttttgcattatcgtttctggactaaatttgaggggtctcagatcaccacctgttatagcctcctgtgttatggaacaatttcttacaaactgaacatcagagggatatacctgtggtattgacataatgcacttacgtcacaagtcaacctctttatttggtttccagatgctaccgtcactcaaaatgtccatgaagagaggatggaaaataaccaaccacaacctagttatgacttgtcaactgttctaccaggacttacttatttgacagtagctggtattccggccatgagtaccagggatcagtgtatgtttgcttattcagttgtactgtcctacttggttttcatatgcatgcctagtgtcatgaataggagaaggtggttttgttgtattatctttcatgagttcaatttgagtgttctcagatcgccatctggcatatcctctccggctttatgatatacttttctagaagctgagcatcaggaagatatacctgtggggttgacataatgcacttaactcaaaacttaacctctttatttctgttccagatgctaccgtcactcacaatgtccatgaagagaagattaaaaatggccaagcagcatccgataatgtcttctcgactgttccaccagcatttattaatatggcagcaactggtgtttcatccatgagtaccagggatcagtgtaagtttattcacttgttgtactgtcatacttggtttccatatgcatgcatagtgtcatgagggaagaatgtagttttgttgtattaccttttcaggcctcaattttagggttctcagattgctacctggtatatcctccttcttaatgagataatttcctagatactgagcatcagaggggtatgcctgtgcggttgacataatgcacttacctcacgcccaacctcttcttttgtttccagatgctgcagtcactcacaacatccgtgaagagaagataaataacagccaaccagcacctggtaacatcttgtcaactgctcctccatggcttcgtcatatggcagcagctggaatttcatccacgattaccagggatctgtgtatgtctgcttattagttgtgctgtcctacttggtttccctaagcaggcatattttcatgaatggtagaaggtaattttgttgtatattctttcctagcctcagtttgaggggtatcatatgtccacctggcatatccttgccttcttttattgataacttcctagaaactgagcatctgagagatatacctatggggttgacataatgcacttacctcacggctcaatctcttcatttggtttccaaatgcaaccgttactcaccatgtccgtggagagaagataaaaaacggccaaccagcatctcataacttcttgttaacccttccatcagggcttattaatatagcaggagctaacatcccagccatgagtaccagggatctgtgtatgttttcttataagttgtactttcctacttgatttccatatgcatgcatagtgtcatcaagggaagaaggtggttttgcggtattacttttgcttgcctcaatttcagggtctctgattgccacctggtatatcctcctgctgtatgggataacgtcctggaaactgagcatcagcaggatatccctgtggggttgtcattatgcacttacttcacagctcagcctcttcattttgtttccagatgtcaccgccactcacagtgtccatgaggagaagatgacaaatggccaacaggcacctgataactccttgtcaacggttccacctggttgtattaatctgtcaggagctggtatttcatgcagaagtaccagggatctgtgtatgtttgtgtattggttgtactgtcctacttggtttccatatgcatgcatagtgtcctgcagggaagaaggtggttttgttgtattatcttactcaaacttagtttgaggggtcttggatcaccacctggtgtatcctcttgcttcatgagataactccctagaaactgggcatcggagggatatactgtgggggtgacataatgcacttatctcacagctcaattttttcatttggattccagatgctactgtcattcacgatatccaggaggaggagatggaaaatgatcaaacccctcctgatggcttcctgtcaaattctgattcaccagagctgataaatatgacaggacattgtatgccacccaatgcattggattctttctctcacgacttcacaagtctcagcaaagatgagctgctttacaaacctgatagtaatgaatttgcggtaggcaccaaaaactacagtgtctctgcaggtgacccaccagttacagtaatgtctttggtggaaactgtgccaaatacaccacaaatatctcctgccatggcaaagaaaattaatgatgatataaaatatcaattaatgaaagaagttcgaaggtttgggcaaagtaagtactgcaagaatgtctatcaatgaaagcatgagaagtgtctcattctatgatttagaacagaattgagctgcctcttgagctcattgtttggctgaattggatctatatataatttagcatggctttactttaatttcactgaaaattgctaatatgtctgcttaagtgttttgttttcctttgttagtgttcacaatagtttccttagtaatatacagatgtcgtgatttaagcattcaaaacaagcactatgtaacattgtagcccatgaaaaatgtatactgtggtagtggatgcactaagattgaggtatatttcatttttgtaattgtagaaatactaatttttaaaatatcttcagattatgaaagaattttcattttgcttgaagaggtacaaggatctatgaaagtcaagagacaatttgttgaatttaccatcaaggaagcagcaaggtgagtgcaaaaaggaactgtgctattgttttaagcacttgcgcccaatttgggacaggggcaggaaaaaatcatggtttgttcctcctaatccctggccctcaatcatagttcatgctatttccacaggcatttaggttgatactatcttattctaacactttcttccaataccatggaggcttccaaatttatcaaaatctgggagtgtatgtgggccctcagttgactcactttgtatttttctagtttgtatctttcaatgaggatgcattttctgtttgcatgtagatggtaaattctattttgtatccactctacctcttacatctcatagatcctgtaggtatcctctggtgaatggaatacctctttaatttcaggtttaaaaaagttgtcttaattcagcaactcgagaaggcgcttaaagaaatagattcccactgccatctcagaaaagttaagcacatgagaaaaagataattgtgttagtgcaaagaccaaggagaaacaaggacatatgctgtaggatggaacaggttattgctgaagctccctataatcctgaaatgaagagaattcccttccagaagctacgaaaaagggagctgtttaaatttaataaatctctgttagtaaaagctgca

SEQ ID NO: 1532 - DNA, 507061 bp, Homo sapiens
  misc_feature (357877)..(499876): n is a, c, g, or t
atgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccgcggccgcgggcagcaccgccggcagtctgcgggagctggcgaccagcaggaccgcgccggcggcaaaggtgagtatctgtctcggcggaagtggccacggcacgtgggagtgtgtgggtgggtgcttgggcgtggggggcagtgatgaggtgcggaggagaccacgggtggtcctgcgttggcccactccgctgttgctcttcctccaacttcgcttgcttggtggcggcatccggcccctgggcagctcgccgcttgttcacgtgtgtcccatcctcctgtggagtgggcacgccttcctgtcccgtcgctcacccccgattccttggccggacttgttaccctgcctcttaaacttagcatcgcccttgcgtctccctagaaacggggaccttcttcctctgggtccccagacactccctctgcacaccctgggcctgcctagagaaaagttagcccttaacgtttctgacagggctctgatggctgctctgggaagcccgcgggcctcctgcctgcggtgtggctaaggaggggagggcagaaggcagagtgggactggggtttggaggaatgcttctagtagtctggaaggagttaatctggaggccccaggagccttttgacccagcccttttggacttggcagtgtctaaccagaagccaaggtcttctcctgggctcccaggcagggttgcattcccacgggggtcatttatatttattattattatttttggtacagccgcattttagggccttcgctgcttctgttttagacgaaagatcttctctggatggcttcaatgatttggttttaaaagcttcttacagcttcttattacacacccttgccaccttgtgaacagttaccaggagagagggcatgggatgctggtttaaatgagaaaagaaaggacccgggttttgttaatttctttaaatggagaaaagcacttaaatgttaaaaaaaatacattatctattggaataatcatttgctttagaaacacaactttattcctctacttttgaccatttaaggagttggtgatgcctagtccttccactatgtgtaatcctgaaatgctgggaacattctagcacctggattaggcagtactgcaaatctctaaggttaaggttaggaacttaaacccttggatgttgagcttgagttaaatgccatactttgctgcaatgggtttttttttctatggatcaggaagaatggggacagtcaaggatagtcactgggggtcacttggggggcactgctgaaggggaatttttttctttggttttaattgtgattaaatccagctaaatgcttgcgttagaaattttcaaacttttccttcctggccttgctgtttttgatgtaaggtatttataattaaatatctttatttgcagaataagtgggttaccttcttctgttctgataaattatgtgatattcggagccccgcttctagtaaaacgctgggacattctgatgaccatctgtttacagatgtcctctcagtttatcttgggggactttgtgtttgaccaggaggttaggaggtaacctctgacatgtgacaggctgaagctttgatgccactccgggaattctgtggcatttgtagtaccttttagaacttgtcaaaggggttgaagcttggaactttttagtagtgacatttagtattagcaggaaattgatgttttactcaccatatgttgagacccttggttgactttctttatgggtgcatagtcatgttcatgactttttgtgtttttgggatgtttctggatgttgtttaatagacgagcacttatttaactaataagcaggagtcccgcatggtgtattcacactacactagcactatactaccatgctgggataatagcattaggtccagcacatgcttcgggagtgggaaggattgtaatagcatatcaggcattgagcaaccctatacagttggttgacaaagatttcggctgaaaattacttttggtactttactgtccattggaattgcttgactcctgccaggaaagttgaatgctggatgttgttgcatgttgtttaatagaggggcacttatttaactaatatgccatgatagcaggtaaccataaatattacagtcccatcattttccaattagaagctccttacatcttcttttgggccaattagggtatgtatactttttaggtatataggtaagtattggcatagcttgtttactttattaattttgttacggttcaatattttgacagctttatttaaaaaaaagttttaatttctgtttggttttactggcaggacacaaaacagtgttttcctgaactctttacctgttgtttttcatcggttttggtgatcaccagagtacttggagtcccctgacgtggttagcagaacctctcagctctgctctcacctgagccatttgagataaagcgcttttgtggagtcagttaacgatgctgcccctggaaataatatacccagtgacgagtacccatagcctaagatcaggagttggtctttttatttgcctgttggcaaatactatatgtgtgttgcttcttaaagtgtgttcatatgtgttacttcttgaagtgacctttaaacagtcctgttttaatggtactgtctaacccttgcagttgctaatgtatgctaaatttctcaggctaacttgtttgtttattgttttgttttcactattttgcaagaaaatccctttaacatcccaagctagcatcaatcaaattgtttcagtgcagtgggagtcttgctaaaagagttttgtggttccacattgagtaattcaaaacatgctttttaatgtaagtgatttaataaggacttgaatatcagacaattccaattttgttttgaaaattttttaaatccttgacttatatttgagcctatacagaacatcttctgcagttcatgtagactcggctaggcactattataggtaaacaagactggcttgggctttctggatggagctgacagtagaggtagtgagtggttgcaagctgtctgcccagctctcagaaggtacccgtgggcactgaccggtgtcactccagaattctgtgagggttacaaggaaggacattgtcacaaattaaagaattctagaaagcttaggcagtgcctttgatgatataaaagtcggcattacagcctaataagtttatctgtattttgtatcttgaggtacagtggtatatgttcacattggatccgtttgaaaatctcttctgtgtctctttgacaatgtgactgggacttaatagagaaaataatttaagttggagaatcataaaattatatttgttaaatattttattttataagcatacacgtgtatgattcttccaccattttttgagtacagagctgaggacctttctttgagttccagattgtctttttagctgaacacagtcaccttttatgattttctatttgtttctttcaaatagagtgaagactaagattttcaaaggattctgaatagagcgtcatttagattttaaataggacctctccactaatgtttgatgttctcatttacacctgatttgaccattttgttagtgtttgagtctttcatacatggtcatcttgatttcccaagggacaatttttttttttttttttttgcactcaaacttctttccctgttacagactattgaattatggtgcatatttagcattatgagtacaacttgcattagcatagttgggaataaggacaacagatccctgataagcacaggcttccccaggcaggagtggctggcccagccttgccaggctgtagtctctggtgggtgtgggtgactttggctgtgttacagaggacgtggaatgttggttagtccagctggtcagctagtggaggccaggatagagggtgtctatggtatctggaagctagttaccatgttctttgggtctcgacagttgaactgcttatatacccgagattttctgttgaacatttactgagtgcctgctgcatgctgggcactttgacatatatcaccttatggaaagttcacaataatcctgccaagtggctggtataattattattttgaggcccagagagattgatatttgggcaagtcagagagctaggaagtgattgagttaggattctgttcctccgcccttctgtccagtttggctggatggttgggatgttgtcgtggttcggtcttggatataataaggactccagaggaaaaggctggcacttgggggcctcaccaaaaaccagacagctcacaagagaccaaacgagtggttgatatgacagctgagttacagcaaagtcctgttcagaaggcccctgagtgtggaaacagcagtttgcagccagcgagtgaataatctaaattattatttattgagcacccagtgggaccaggtgtgaatgaagcctctgctgagggctaagggttgagcggtgttttaagtgtggctcatctggtccttactgcaacttggtgaggttgctagttacacaggtacggaaattaaggctccagaatttccttgctgagcggcacacagttaatgagggtgttttttggaagattaactttggccttggttagaagagtcctcttactctaccacaggctcagctcgttggtagcacgattctaaacataagcagtggccaccccttccattcaccgtgcctcacggctgcagatgctcttctatgcaaggctgctgtcttgtaaacccacagagtgcacagagcagtgtggcccacaggaaacagcatcaaatctgttgtggctttggatgcaggtgacaggcagctctattaatatgtaagtgacatgaacaggacattagtctgagtggcctagctggctaacccagcagctctgtgctctcctcactgatccatacttggtctgcccttctgctctgctcctctgttggcttcattctcatccctacccagtaggtctcaaatagaggccgtggcttcaggtgtcacagtcccatgacaacacccagtagtggagacagcagggtttcttccccttgtacttagtctccaagtcggtgagcaaacggtgacccagccccaaccccatgtttcttgttacacccctggggacagtgttgcctcccaggctggtgtctgaagcccacacacaggactgccttttctcctgaggcggtggcctgccacctcccccaggacacgtggaaggaggggaaggggtggtgggaatcccactgaaggtggttttaatcttggcttccacacttcctcaccatctgccccggggcaaatgggctagctttcctgagacttgttatcagtgaattagggatgctatctgcttcttagataaataggataacgtatgtgcagtgcctggcacacgtgattggctgtcgtttcagtgcctgttcctaatacgaaaatcttcaagtctcttatcacgcgtgaggcacacctcagagtgcctgctttgctgctggtggatttgtggtatttagtattctaagttaagggtgtgtgcgtgtacgtgtgtggatgtggatgtgcatgggggggtgtgtgtgtgttgtgagtctgatatcatgctttgcctctagattcagtcagtccatgttgtggaaactggatcgtcaagcattactgggcatctatgcggagtagttgcttgagtctgttggtttcctttttaaatttgctccaagtttatctttattatcagaggcagtgttcatgattcttacaaacttcattaaaagggaaaaaacgtctaagccataatctgctttaaaaaaacagcaggggagaataatcctgctcagttgctgatccagcctgttggcaggctatcctgaaaacgagcccacctccgtcatccgtaggacacaatagcttgtctacagctgcctagaatcaggctgcttgctgtgatggagctgagcagaattctatccaattgtttcttcctcctggcttttgagagcctgcctgcttgctggagcatgacagattcggggctcagttttgcaattgtttctagtgtgcatttccgtttgatctgtatttaatctctatcttttacagttaacatgatcttttttgaggtgcattaaaaaaaaacacacacatcagcaagcatttgctgggggaaatgctcttgatagcaccacttgaagaggccaaggtcaatttttatcagatttgccttgcttgggagatcttcagatttgatgaatgtgaaatgcatgcttgatgggtatcctattggaattttaattaactttaaaagaacagggtgtcgagctgaaggtattggcaacagtgaatggtttacagatcatgcaggcaccccataatgtgagcctcccttttcccattgagtgaagttggaatgaaaaagtgtataaagttgcagcatgatttgtattctgctttctttaggctctcctggcccttgatggctctgcacatccttggaggccatttagagctgcagctctcctttgggagacctgaaggaggcccaagaagagtcactgcgctcttgggtagcacgtgtttacattgttaactgatgcaaacgaagatatgatggtatttgcatttccacttaatgtaatgtgtgcataaggctcacatgaatttatgtgagtttaaatgaattaggattgaccacaggaattcggatcaggaggaggtgtgagagaatttagaagcatgcttgcaccggggcacctgtaaatgtgctgcagccgggctctctgagagcaagacctcaccagagaatcagggagttcgcagggagccatctttaccctggttcaaggaatgggatgctgatgcttttctctctctggcttcactgcacagatatttaagtacctgctgtgtaccatacactacagtggacactgggggctccagggacagcgattgcattggtctctatttataatgaaatgtaattttttttccatttagttaggtgaccagatatgctgcagaggaaaacatgtgtctatatctttttattctctgtttatctggcaggaatttctaatgaggaaagtggtattggtgtgatttggggcttagtgagtttgcagtgggttctcacctctttttgtttattcttccatagtctagatttgccaaatgaaggctttgcacttcttctttctgaatctttctgactttgtggtggggaaagaagatgatgaggcaggtccatcccacagctggaggctttctgagagcagcttggtgttgcgggcagcacctttcagagaagctgtctgctgtttgctagttctggagcagatgctctggaagtgccacatgctcaggagataagagaacttgctgctgtggctaggacgatggaggtcaggagtgtccagcacgttttctgaagattcttttaattttttgttggccatcaaagcacaccaccttaggtgagaattatttggatttatcatttaggatctaagatacattcatgggtgactgcattccatttgttgctctaggatgaacccagagatactggagagaaagaggaaagatgagggaggcttaggcacatttcagtaaatggttgcaggttaactaatctcattagacaccacccgtcctgatcagccgttgtttttgcgttcaaagactaatcggttaatcctccaagctttgcctgccactgttgctgtttgatttgaagggtcaaggaatccttcagatgattactaaacacttggagtgctcacccatgtgggttgaggaaagtactcctgaggctgggccagctaaatctcaggccaggccgacttctggaggtgttgcctgtgtggagtgcctttacccataaatgcaatggcagacacatacatttatttcgcagatcaaaatttctttttttttgagacagtcttgctctgttaccctagctggagtgcagtggcacgatctcgactcactgctacctccgcctccagggttcaagctattcttctgcctcagcctcccaagtggctgggactataggcgagcaccaccacgcccggctaacgcccggctaattttttaatatttttagtagagagggggtttcaccgtattggccaggctggcctcgaactcctgacctcgtgatccgcccgccttggcctcccaaagtgctgggattacaggtgtcagccacttcgcctggcctctcagatagaaatttctaaaaaatctgtagggagaaagtagtggggtttcagttttgcatgtgggaaaaacaaaaggcttgggagtttagctgtaaaagaaaggacagttgctgttgttgctgggacttcaaggctgttgtaaaaattagcttggtgctgcatttgctggcaaagtggcaagcaaattttgagtaatattctggacttcatgtattgtattgaactggatcttttagagaggggtcagggcagcccctgggcagcccgctgctgctggttcattctagtcttcctgttcatctgcagtgaggaagtgggtcactcttcctctgggtctgcacaccctgcctgcagactgcagctgtagggaacacacagaatgaatggtggcccaggtgctggggctgtggagctgtcaccatggccctgtgtgagtgctgctcttgaagactggcccagaacgagtgatgttaataattaattcagtccacacatatgtactgactgcccaccctgttgcaaatactgtgttaagcactggaatatacattgttcacaaaaccagaagtgatccaggcctttctgcaactgaccattcagaggacactgtaaacaaatagccaataggtatctcttgacatgtggtaataagagacatgaagacaaggggccacagcctgatgatggcaggggacgtggagtcatgggtgatgtctgtggatttaattatgcagcttattttatttatcaaaatgtatccacatctttactcttttatggataagccactggattccttaactctttataatcatatcccaaatctgcgtaacttaaaaattgcatcctattttctcttcccaagcacagccaaaggtaattaaaaccagatgtgtttgcatgagaaaatgcgtgcagagcatcaagaatgtagattgtgctaaattaatgtcgccttaacaaagatagccaatgagactgacctttttttttttactgagttcatgatgcccatgggttaattttgtcactagcagtcattgtctggaccaagtttgtagtctaaacatgtgcagtatgaaaggtgaatgctctcacacagtcacactcctaataggaagacaactctcttgtatcctgagcggcatcccccttgtgccttctgtggctgaatttgtgttgtggactatagcagagggaaaacttccaatgctagaaatctgagttttaaaaattaatttaaaaatgtgttccttatggaattgggagtgtatctgctgtctcggtttgacaaactaagctttgacttgtgtacagtaacaagagttttcctggatttaaagttgttgtccccagcatatcaaatgaggtgacgtatatcagatcctgtggttgagcctcacagtgcagaagggcacctgctatgggtcagcagcccattgaacaatggagtttaagacttgcagtttttgagcttttcaatcacctctttgccaaagaccaatgtgtccattgcttggcagtttgacatctggagtcgtgtggacaggggtctacatccaaaaggcagcgccactggggcttagtttgttcaggtttgtgttcctaggcagatggaggctgtttgtctcaaatatagctgctttaaaaaaacaggagggtttattgatcagaggtagtgactcatgacgttgaaactgtgcctacataactcacatgacaaggctggggtgaagaggacaggtctgcggaaggctttccacttagtcctgggaggccccttttccctctgtccaccgtcccctcctgcaccatcactgtcacttcttttctgaaggctgcattgatgcacatggttggtgcatatgggtcgattgatgcacgtggttgcatgtggttgacgcacgtgtttggagttctctctcttcctgagatcagctgcatccagccatggaccttctcttttgccggttctttgtgaatcataaatctacttataatgcctttacatactgatgttctttttctatttttcccagacttcagaaatttcttgcctttttttttttagagacggagtcttgctctgtcccctaggctggagtgcagtggtgcgatcttggctcactgcaggctctgcctcccaggttcacaccattctcctgtctcagcctcccgagtagctgggactacaggcgcccaccaccatgcctggctaatttttttgtatttttagtagagacggggtttcaccatgttaaccaggatggtcttgatctcctgacctcatgatccacctgcctcagcctcccaaagtgctgggattacaggcgtgagccaccatgcccggccaatttcatgctttttagatttatgggaaatagaattttttcccttctgcaaaaggcctatgtgctctacacgtggttaatagccagtctatgcaatatgattgatgttaaaggtaacatctcctctgtgtccccaaactaatcagtgccccatcttagactatcaacacctacacagtctggccccaggggtatcagttttccacttggtactatcactgctgtaaacaacttcatgggctgagaagcccttactttcataacccccaccttccatccggggctgctgtgaactggacaaccctaaagcatcctgacaaccagactcctgttgggcaggcggtatctggctggtgtgagccatttacatcagttgtattgaagggatcaatgctatgctgggacccatccttggtgctcattttagtcgacttcatccaggtggaaagatgcaaccacaccccccggagcccaggtttctgcggattcctctcttttgtctcccttctgtgcagtttctggctccatttttatttgttcaggctgtttcagtgacccttcctcactcttcccctctgtgggccgtgcgcattcctggcaaccagtgctctgtcggcttttgcagttgccactggctggctttctggaggcagcctctcgtctctgcctgggtccctcttcctccaacttgctcagtgatgagtggggctcagagcctcactcacaggctgccctccgcaccgcgccaagctcatgggaggggctcgagacctctgcagcacctaggcacatgcctgcctttcccagtgaccaggcccagcccagagctgagcccacagctgcagagatcaccagtccccaggctgaccaattctttacaggtgtaggctgaagctccaacccactgcacttttctctatcgtgaaatcggatgtgaatttagggtgcagatcccaggaagagtgatgacgcctggggataacagtgtgtcttgacagaagagttaggacccaaagccagcatctcccaggagaaagcaaaatagtcattttctagaccccggggaacaagtctcctgacagtatcaacaggagggggtactggttggagaaggaggtcagggtgacggttgtgtccagctcagcaaagccaggtcctcgcctcctttcacccatgggaccccccagatgtgccagtctgctgtcggctgcctgcttctcctacctcctgcaagctctgcaggtggcagggccctttctacactcacggaagtctcaaacaaacttctgtgacacctcctctggtgtgtggccatcatttccagccccctgcccaagtcctcttctggggtccttgagtctcctggggggggggtctcaggtatgtgcctagaacttctgctgcagcccctggcctgtcccctgggccccaccctgagtcacctaccgggtggggtccctgagctcctggagagcagcaagggaatgcttcccatggtccagccccctgggcggactcttgcgcctttgtgactgggtgagctgtgcatttccagttctttgccagctgccccacctccccacccacatcccttccattggtgttctcaggaataggtgtttacagtcttattttttcttaaaaattcccatgcatgttatattctactctaaaatgtgcctcctctgattttaataggaccccaaagcaccctgtggggttagctccacaaacttggaatcaaatatgtgtcccgtgacttcttcccattccctggcccccagcacccacacaggcacccagcttgcaggcacagcggccgagagtgagggaggggctgcctcctgggctccccagggacaacggggcactctgctctccccagtggctgagggaggaggattctagtcctgtcaccagaagcctctctgggttctctgggggcagaacgcctctgcttggctgcatcttggagccctccatcctggagtcacctgtgaggtcaactgagcggagcatgggctgtcgggcctgggtttattttctgatcgttggtgtcctctggcttcacctgccaaagcatcgaggattgttgttgactgatggaagtgctataggcttgtcggtaaatgtggggaaaggtggctgtcattgtgggacgttttcactctctaaacttaagtgggaaatttctgtcaggttgaggaattgtcaaggatgtcggctttcaaggtgacaattgtcgtgctgacagatacagcacatgggtggtagtggagtgccgggggcttggggctggtgtcctggctgctggagtgtgatttggcactagagatgaggaaagggaaagtgccactgggatgctggtattcctggtggtgtccctgagcccgggaacccagtgtggggggcctgccatgatggccacaaggtaacctcaggaggaacctgggaaacgttttatattaaagttttcatttaatggtccattctgtttgtcaagtggtgcatatagaaaaattgtggcagttgcatggaatttcatttggaaacaaatttaaataaaaagtgagtcaatttaaaggaactcattaagtaagtatcgtgaaactgaggcttggaggaccatagtttggataaaaaatgccttaagttgaagtgaaatcagaacctcaaagcgagatgtgcaatctcatgttcatttcagcattattcacagggccaatatctgaaagcaacccagatgtccatcaccagatgaatgataaagaaagtgcagtgggctgggtgcagtggctcatgcctgtaatctcagaactttaggaggtcaagacaggaagatcgcttcagcccaggagcttgagaccagcctgggcaacatagcaagtccccatctctacaaaaaataaaaaaagaaaaaaagaatcagctgggcatggtggtgcatgcctgtagtcctagatacataagaggctgaggtaggaggatttcttaagcccaggaggttgaggctgcagtgagccgtgatcgcaccactgcactccagcctgggcaacagagtgacaccctgtctgaaacaaaacaaaacaaacaaacaaacaaacaaaaggctgcctgtgctgtgctgtatacacacacacacacacacacacacgtatatacacaaacaatggaatattattcaatcttaaaaaagaaggaaatctttccatttgtgatggcatggatgagcctagaggacgttatgcgaagtgaaacaagccacagacacagaaaggcaaatactgtgtgatctcattcatatccggaatctaaaaacactgaattcatagaagcagatagtagaaaggtggttacgaggcgccggaagtgtgggaagaggagatacttgtcaaagagtaacactttcagttataagatgaatgaattctggagttctactgtgcagcatggtgaccatagttaacaatactcgattatatacttgaactttgctaaaagaatagattttaagtattttcatgacaccacgaaggtaaccacgtgaggtgatagatatatattaactggaatgtatatgtatatcaaattatcacttgtataccttaaatatatacaatttttatttgtctgttatacctcaataaaacaggggaaatataaatttaacatgataatgaaaagtacttttaaaaaacacacaaagctgcctcaagtcatagaacaagcagacctagctttcaccatgacgtctctaggtttgttctttcagccctggtttcctgtgtgtctgaaggctcacgcccagctgtggatgtgctgaggctttgtatgagggaagagtttgaacgaggtgaatatgaggaacagggcaattttatgcttgcaagcagcgttgggaaaattgctttgtttgatttttaaacctaaatggcaaacatgagaaacccagcctttgggatttattttggacatgacaggtgttccccgagtccttatgccactgcactgggtccaggttgggccactcccaggcccacctccagctggtgatgcatgcctggcaggggccacctcacactgtctgcatcagtcaggcaccaggctggagcctgagccacagcagagcactgacccggggttgagaaccaagagacgggcagggggcggaaggcatggtgggaataggcctcgctcagcaagctttgttcccagagctggggtgctggggcggtgtggacactgcgcactgtggggtgagcgcgttcagtgccgatctcagggcagcgggctcacacccggctcctgggctctaacaggtgtggcataagaaactcagggctccgtgtcaggaagggccctttggagaagctcgtaagcagagtgttaagggccctcttacggggcctggagtcatctctgagtcttccctcaccggctctgtctgtgtctccaggtttggtcatttctttctcttgtaaggggcagttcactcctgcctttctgctgcttctgagacagagccgtgtcctggctgggtccttcctgaccacggtctccccagtccatctgtgcctgtggccccggtgattgtcttaaaatgctgtttggtggttacaagcccactcagccccctttagtccggacttcatgccaggtttgcagtcccatggccctgctcatgaccctgtgagccctgcccctctcttattcctgcactgtgttcattcctgctgttggctctttgcttatggaagaccggtcgccttcaccattggtctgtctgtccgtgagggaatgccgcctcctttctcatctgtgggaggctgcagagaagccctcatgaaaggggctgcttcctcacacatcctccacccctaggctgtccggggggcctcactgttgcacgcatggtcgagcgacctttggcactgctatcgccatgcgtttctagactctcgtggacttcctaaggagcacttttctagaatttatcttctggttgttttacaggtcttgggtgttctcacaggtcaggaccacaccatccgttgagcctccccacccgtgtgaaagggcgggaacccaggagcagtattggtttgttggttggcatggggtcaggggtgtagtggccagtggcaatgcttccacatcaccaggctgaaaggcaggacggagccgcagagctggggaggctgcgtagggctatgggtgtgcgtggagccctggagcccgaatgcctgggttcatgtctccctccccacacattgttgctgtgtacccctgagcaagtcaaggggcttggcagtgtgacctcccggccgcagtgtccttgtctatgtgggccgacggagtccatgcgggccgagggagtccatgcaggaaaagtgctgagagaggtaccagctgaacagttagatttagtgaaggtgaggtgtcaccactgttactgttcttgagtcttaagttttcattagaatacgtattagaatgcatggtacactaataatggccattattattggagctaacacttgttggtcacttagttctggctgctcttatagccagattaagggtcaggcaaagggcatcagtaaaggtccctgaaatgttactgggacaaattgccaaagggatcattccagcttcccaaaggtggccagggcctcaagagcaaaagaatactagtgactaatcactcctctgtatcactggcccatttctgtggagtctgtggagtcttcttgcatcaattccgtgccaagaggcctccagtgtggtggacaagctcatgggtcctgtgaatgttcaatggcaggaggaagggcacttcctagcactttcttgtttctgtttaggatccaagaagcctacctctgaatgcacgctctccccagcaccaccttcaggcccagcccttcctccaccatgggtctgcaccatgggtggctgactgaccatctccttgaggctgctttggtccccaaagtcaggctgggaccctgaggaagggcctggattggggggccccatagagtctacatctgagtatctttttttacaatccttccttcgaaaacttgcggatctctcctttctttagtgccccccccattccttctgttttcctctgtcctccccttcctaaccctcccctcccctcccctccctctcttcccctcttctcttcttttttccctccccccccccccccccgccccaatatcctatgaaggcctcagagtcctgttagaaaacacttctggcagtaactgttcccatctttcctcctgggcccttccctgggactcatctcccaacctgatgatgtctcaggctttctcctaagtagaggctctgccctcccaacaactgtccaaacaagttctcttcttccctgtctcgttttcccctcttggtgaccctggagcgagtcagagggtgggtttctttttgtccaaaagacagaggttggctggcacttcctcaaggtgcctgggagaaaagaccgggatgcctggactttcttggaattacagctgtccgctgctgctgagaggtttgctcgaaagatgtaaatatgggggtgtggggaggtggtgctgctctctctctatcagaggcacatcagggaacctcaaatgcttttgtggacgagactatctctgcgctgataagcaccttgttgttgctggggccagatgaaagatagttgttgagttgcagcttcagtatgctgtttgtatactagagaaacatcatatctgtgcgtatttataattttccatctaccacttggtcaacagatctgataagaagcccacacttgaaggaattagcactaaatggaatgctaaacatagtaccgtaaatggtccaaaaagaggcctagtcaattattcaggagggttatatcaaggtctcatagcgtgttatcgattcccagttctcttgaaaatgatttatttgtcaattgcccatgaagtgacctttcttgtatagtttccggcttctgggtcttagggcactttggttttgtaattttaatttctcttctaaatatttacgaagttaacaagcagttgttttagctaaaatatcccgaattggagcctagcccattgatctgtcatttaataactcctgtagatgagtatgcatatgcatttccatatatacatataaagttagaccttttataaactctgcgtttatagttattgattggcagttcatctctttaaatgaagagttttggggactagctcatttctgctgatctttacaggtttgcttaagatctgtgggcccctcaaaatccatggtatcatggacaaggtcagtcgggtggtttgttgcatggtgactgtggaattcgagttcagggaagggaccatctggctgggctgccagccgggtcctacacagccccctttgtgtggccttttggtctcatgcacccagtatgcagtgtgttcttaccgatggtggaaacctggctctcccacctgcctgctctaggactcaggcaaattgggtaccttctgcagtatctgttttctcttgtgagatgggccccgatcatgccacatgagcagagcacgtgagggaatccaccgggacggtgtgctgcagccagcccaggccagagcgccatccgtggttcttcatgtcactatggcagagctcatgagccagccatcatagggagggcttcttaaaggcgttctttttttccctttttggacaaattggtaagatgctgtagctcaaactgtgtacaaatttctgcacgtgtgggctgatactttggaagaatgaaagaagggttgagtaattggctctggggaatattactgctgactggtgccattttgatgagtaatagaccccattagatcacagtaaaatactcgattatgtataattaaagatggcattagtcaggcagaagccacagcgtttaaaaatgtgaaagggataatttctaatgctgaaaagtgcattcatggctgaagaagcagagcgtaatgtgtagtgaattgagttctgaagttactggggctcggtcatagacagatgcttgtttagcaggacagctggtgttcttttatttttaggtctcaaaaatgtgtagggacagcaatcatggcagtgtttttttttaaaaagtattttaggtgaattcatggcttgtggaacaattctgattggtggttttacccaaaaaaaatcaagttctagactttattctttgtggagcagacagagcccaggcaagctttgggaatctttgtttccctgtttgcacttctggctttcaactgcagatccccctttctcttctcatttattcatttgctctttccttccttcagaggcttcaattgagtgcctcatgcaggccagacactgttctgggctctgggaaggagcagggagccaagctgagactggcctaggagctcacattgatggagtgggcaggactcagggcagggccacactgctgtccttggtccacacccactgcttttattcggacttctctagtcagacactaagaatgttctatggccccccgggacccgttctctgggagatccattggcttagagctgagaagtctctttggcttgacttgagctcctctactccatttaatcaagagtcaagtgtctggcagagactttcgttattaataacgtagctattaatattcacattgacagtcatttgcacttctaaacctctttaatctcagaggttgccacagcatttcatggacctcagatgaatggcttcaaaggaaggcacagggctctctaccatgaggacccaaggggaattcgcttgtttgacagagcaagtgtgttaaggcagccgtccctgggtcttgcatgcaaggtccagcaggaggacagctgagcatctccctgcacgtgtccattgagcacccacatgtcctttggctctctgtggcagcagcaacgttgcagagagcaagatagtctggcctcgtggtgcttacgttctaattggtgccatgggggctctatcaagacgttgtgagtaagtgacaattggaaaaccttagctacagtggagatgctttgtagtgcaggtatttttgtactccagttggacttaattaagattaaaataccagggggttctttttctgctcgtggatattttttgtcccagtggaaggttgaaatcactttttaattgcagctgtgttcttttattaaactagtggttcttgacttggggtgcatgttgaagtcccctggggaacctccccaaacactgatgtctgtctcagcccagggccctgtgatgggtctgggtgcagcctggcatcagattcaacggtccccaggtgatgccagtgctggggtgagcagcactgatctaaactgcagaaggccaacaaaaggtggtgtagaggaagtggttgtgagagccagcacctggagaatcctgccagatctgcacctggaagatgagttggacatggccaggtaaagagggaggaagagtgttccagcggagggaatggcaagcatggaagcctagggtcctgaggagcttggagcaaatgaaaggaggggaagggttgggggagggggcatgaggctggagaggatggccgaggcaggtggtacaagaccatgctagggatttttgtctataacctgatgatagtcgaagccattttatttatgagcctggaactactctgctcattatttcacttaaaaaacaatttcttagaaaaatagtttttttacaaaaacgaggaattcaacttattaattcacttagtctgtttaaccacacagtgggacaggtatagataggtgctatgattacccccattgtgcagacggggaaagtgaggcccagagaagttgagtagcttgtcacacagctggtgaatcgtggagctgggatctgagctcaggctgcctctggttccagtctggctctacatttctgggggattggtgcgatgagcctcatttcacagagcaggaagtggaggtgtgggttggggttagaattctgttctgatctcctcaaatctcacactgttacctccttatcaggctgttcagacttggggagaaattaaaaaaaaagttttgtgcttttaccatactataaatgtgaaaaaaaatatgggcatataagtcagtgggagagctttatggctgaacataaagagcattcaaataaagaagctagttatttcaaggtgctgatgggggaagtcaggtggtaccttttccattgctgaaacattgatgaaggtcgacactgcttatggagtgcaatgcaagggagaggcttttatggataatattgcatcattgcacaaaagccaacagccacaccaatgtatttgccctgcatttggtgaggggtggtggtccttgggttcttgcttatatttgatgggttcttgattcacaaagtgcaatgaatatattgaaaatatgtgtccagtggcccaggacactgaggtatctgtgctgtcttcttgtccgaggctttttcatgtttgtggggctccatgtttgtggccatggaaacagactgaatacagaattttttccttcctggaaatctgtgcctacacgtctcagaaacattcatgaaaagctaatggtttaacaggtgttcaaataaaccatcctttgatggttcaaattcctaattttatactccaaagcagcaccatccaatacaaatagaatttgagccacatatttaatttaaaaatttctggtagccacgtcacaaatggtaaaaagaaattggtgaaattaattttaagaatatatttaacccactgtatccaaaatatgtcggcatgtagttactatgaaaacttattaatttgcatcctttcatccatgctgagcctgaagcccatgtgtatttcacccctgcagtacatctgaggtcacacttcccggtttccagggcccagtaggcatgtggtgcccacaggtggctgctgtatggaaaggctcagctctgacggatcagaccacttcagatatcataataaagttctggcaccagtgcactttttatgactctaatagatttgcatctgcaaattgtggtttataggcaacaatatgacatttcctatgatttccgaattgtcatcatgatagaatctgcagaggactgcaggaatttttggtttgaagttaatataataacagcctggagggcttataaaatgcatgctgagaaattggtctgaaacccagattgaggatatttttcatacccagctgattatttaaatttcccaatgggaagttattacttctctgacaagtctcatcagcagtctattttcagtggtcttgatggacatggagtctaattttgtttttctcctagcctctttttggagaggatgaaatttggtgtctggaattacatttcttcctaggaaaagtgctcagcgtcttagaaataaattatcacaaaactgtcacctgtcaggtggttcattttccgaggtgacaggcagtacctataatcacgggaggtgggcatgttccccttgttgttgtggtgtgtctttatagttgtggggaatgtgggtgggtggcctgccctttccctggtgcatttggcaaatccctcttatattgcttttgttagctgacatgtacagcaaatcaaataaataattctgggctccgatctcaagttgagaacgagagcataatagccttgttccgggtgcctgatgggcctacagtggcattacagcattcagagcgaaagctcatttactggaaacaacgaagtgtttgaaagttcactgcatggaaattggatttttgcctttttattatttacattgtgtattatcagatttatatttaaagctgtggggattatcattctctttaaacggcattatttaataaagagtaagcatttcatggtttcaagactgctgaacccagctcatcattggaaattcaattaatgggttccaacttgagtaggcatgggcagaggggcgggggggacccagtgtcccctcccaggcccgatggcctgatggtggggtgcctatcaccgtctctcacatgggccctctcacagtgaatatcacctgtctttcaaactttaagagtaaatcttagtacttgctccttgttctcgatggaggcacgcaattgaaagctttaatctctgggatgaaaacttctgggaaaggcagtactttagtgtgaagtcattgttgttatgatgcagctgagtttgagcctgtcttagaagcacgttttgatgggcagaaatggacccagtctacagacaagggaccatctgcaaagacaagacagtcactgtgaagcttttgtcagaaaacccattcccaatggagggggaaggaatcagtggggcaaatatttcaatggaacagaaccagcatctaaacttatgcactgcagcgttctgctaaaccctgctatgggtgaggctgaatgagtacattcatttctaataaaagaaattacattaattcttgaagggaatgtaggtgtttaagctgtcactggaaacccatttctgagaagaagctaaaattgcatgcctttttttctctcttcttcttagtgatttaaaaaaatttgtatttttgctgaggtttggaaaggcaattacgctgattttgcccaaaatttggacagattagttctgctgagaaagaagtaacgaaggtatgaaaggacatgaaataactgaaacttgccaggagaaatattaaggtcaaaagcagaggaagcatgggctcggctcagtgtgcaatgccttatcaccgggtcacctgccccaggaggtgggcccgacagatgccctgtgtgtgtggaagctgccgctgtgaaagagtgtggcatagtaaaacatgagatcaccccagttattttatttctgacacactgggaatgaatcttgatctagtctccagggtgtgtacttgtctgctgtgcgttttgtgctgagctgggttctggtgcattttggctaaagccacattaaccaccccccgacccccgatgccaccatcttgctggagctgagatttcctgcagacctgcttcctgagggctgactcctggtctcccactgctctgggacattagcagtcgggacttgctacaccagttgcagggccgaggacaaaatgaagtgcaattataaaattattaagaatttcattacgtgaccacagagcattaagccaaatttgggcggcagccaagtgacctggtcagtgattctggttggtggacatggaactgcagacaagaaccttctgtgttgatgcatcaaagtatgaacactgtcaatatgctgtggttgccagacttttatctcgtgtgtttaaaactggtttctagagctttgtcttggttagggttcaaaatgtcatccctacatggggctcagcagatgggtctaatcaggcctagcatccatgtggtgctttctgtcatttctggcctcacttgggtgaccacattggatggaagctgggaaatggagggaccaaggaagggagcccctgtttcccagcttgggtaggtgattggggttatcatggagggggtggttttggggaagcttctgggtagggagtacagatacacagaaggccccccagcgctgctgccattgtctgccagtgttgaagctgcagcatcatgggcacggctcctgggaagggaccaccagcctttttgaggggccaggcctcgaggcttcctcagctggcttgaattcttcactggtgaagaaaccaaggctccctaagtttgaattggccctagttcatggccagaagcccactgaaggtcacagtgccctggggtctgtctttctctttgtcctggcttctggcctccaaatgaatacttttggccttgctgtagtgctggccagggtttggacaaggtcaggtgggaccagggtttggacaaggtctgtggggggtgatggtagggactttgggccatcccttagaagtctcagagtgtatgtgtttttggagacctgtggtgacaccaacctgctgcatagagccttctgaagccccactttctgctatggccttggattgccctaaggaaattcttcgggagcagagcgagctccagcttcctcaggtggcctttggagagtgttggctttccaaatcacgacttgtcaaaagaggctttccagatttcaggacatgttggattgatagccagccttcataggagtcatttttctgttgggttcataaaatagagtggagtgtgttctggtgtgctcatggaagctggggctctggcctccctccgggccagggcaagggttccatgagccacataaaggcattttgcaaactacaacttgctatgctgatgttcggtggtgttcggcattttgcaaactacaacttgctatgctgatgttcagtggtgttctcatccatgggcaccttgcatctatgcctattttatagtatttgtggaataattttcccattttaagtgattatagagttggaagttggatctttgttttgttttgttttagagatggagtctcgctctgttgcccaggctggaatgcagtggtgggatcttggctcactgcaagctccgcctcctgagttcacctgccattctcctgcctcggcctcccgagtagctgggactacaggcgcccaccaccacgcctggctaatttttgtatttttagtagagatggggtttcacggtgttagccagggtggtctcgatctcctgacctcgtgatccgcctgcctcagcctcccaaagtgctgggattacaggcctgagccaccgtgcctggccggatctttgttttgatgacacaattttggctatttgtgatttatttcaagcagtgcctggcctgtaactccatcttgaattgtaacactgttcccatgggaactttgatagggtttctagcagtacttgagaacaaaaagggagttcccacatcctgccaatgttgatcatagcacacgtgctggtgtgtgtgaataacgtagaatggaagatgttccagaactaggtggtcagccttcaaactgctaaagctttgttataactattttggtagctgtctttccaagatggtcatatgtattgtaacaagtgctgtattggatcgggctaaggtttccttggcaactcaggatcattctgcatgctgtcactgagctctgcagggattctctggggccccagagccccatgcttcccactggggtcattttgcccctgcctgaaatcacccgtactttgggaagctgggtcctctcctctttggctgccactttgcaggatgctgcctgcttgctagccatcctcccaatttctgcattgtctgatttgcagtccatctcagcagtttggagctcagcttcttaactcagtgaattagcactcggtgttgagttgtgggttgagggggctggcagtgctgccttggctcacacacagtccaaccaccagagatcgagttgctatctcatcttcagtgttttctccgcccctcgcatcttcccctgctgggactgtgctttctctcctagatggtgatcttgctggagaaggaagtatccactcgggtgtttgtttctgaacttttgagtgattcaggggagaggatacactaagggatgaattttaaggtttttttttttttgagatgaagttttgctcttgttgtccaggctggagtgcagtggtgcaatcttggctcactgcagcctttacctcctgagttcaagcgattcttctgcctcagccttctgagtagctgagattacaggtgtccaccactacacctggctaatttttgtatttttagtagagatggggtttcaccatgttggccaggctggtcacgaactcctgacctcaggtgatctcgcctcggcctcccaaagtgctgggattacaggcatgagccaccgtgcccggcctgaattttaagttttttaaaaagggatgtgaagggttgttgtaggagatagaaacgtaggctctctgctgacctgattgccagtttaaaactagacctactcacagaactgaggaatagaggaggcagcttgtgatttattgctaatggctaatggaggcagttaatgctttctttccagttcaaatactatttcttatttaaagactaccaataaggttaataaaggtttttatttccctctgaaatcacacataaatgacatattactccaggtcatttttccatcataggatttgcatcatctgactgtgggaagggctctccttggtaaacacaggtggctccaggctcatagcaccccacaggaccttcttaggttttaggatgagagcacttgaatttgatgtcccagagtgttagaatgttatcagaggggatcatagtattgactggggatattcaccgtctcttctactcctcagctctgctggtaggtctagttttaaacttgcagtcaggccagcagagagcccgcattcctgtctcctacagtgatccttcacagcacctttttaaaaacttaaaattcaatattgcattacaaatattgcattcgctttatagactcccacgtgccatccataaaaatcatttaaaaaggtgaatatgtgtaatgttgccttgaatataaatgacattttcaatctgtaaaaataaaatatctgcatttccatactctctggacaccctctggatctgaaactggccttagagataatctcattgggtcttcaagaacatatgaggaaaaagatttccttggtctcatctggttgttaaaagaaggagattggaacttgggcttcctgaatcccagtctagtgtgcttcctagccacctgaaagggatataaagatgtgattcagttggttactgagctgcctgttttatcacctacaattgaatttaataggatcatcctgagatgccatacaaatttcttgatgtcatcaacagggactttgccctcatcatccagagggtaaaaggacacctttatcaggattgaggattgtatgggaggagcactgcaaagcatgtccaggattaaggccacacagctctcctaggagaccctcaggatggcttttctctgtggcagctgctcgtgtttgatttgcaggccgctaatacaaatccactgtttagtgacgagggagtacttgccttactagtaagtaaccctccttgagcccgtggtatgttctagttctgggctgcgtgcttcaattgcactgtgtcatctggctcctgagcctggagctggactcccattttacagacaagcaaacagaggtggcaagagggtcccatagctagtaaggtgccaagacaggactgtgacccaggcatgtcagacttcaaaacacacgactgcaagctgtgctgggaaatgattgctctggggaggacactgtcctcaggctcctgtggatgactgacaggaagtccagggccacctccaggctcccggttgccacttgtctctttctggtacaggtgaatcagtgatggctttggggactccctcaacgcttaggtgtcctcttctctcatcctggggagaatccagtgtgtaagtgcaggagtctgcatggcttgccttcgtgggtcattgggcaccatcctggggggcaggttcagctgagggcaggttcagtcccccaaggctcagccacttcatccttcacactgaaagatgccttggctgggggagctggatggtgtcatgtccagaggcgctcagggctgtctgacttgcagacagagggtcttcacctcgctgcctgggatgataaggcttgtgtctcaggactttgaggcttgagggatctaagtcgtgagagcatccctatttcttctgataagagatttgaggatttctgagaatcagatgtaattatgccacatcatggatgaatgttttaacacatattctggaagttgctaagtgtttctttcaaagcaagtagcaatggctgattcccgagtgtgcactctggaccagccctggtctacatgctttatgtgtaaaagttcagtgtgtccttatgacaagccagccagctgtgaagtcaaggcgggtggatcacctgaggtcaggagttagagaccagcttggcaaacatggtgaaaccctgtttctactaaaaatacaaaaaattagctgggtgtggtggcacacgcctgtaatcccagctacttgggaggctgaggcaggagaattggttgaacccaggaggcagagggtgcagtgaacccagatcgcaccactgcactccagcctgggcgacagagtgagattcggtctcaaaacaaagaaacaaaaaggtgcccttacacagtgttcacccatgagaaggggactcaggtacagagcagggtctgagccgtggtgccaggctctgctttgagcttcccctccctgtgctctgctgctggccttcctgcatgggctctatcccggcgcagctgcctctctctcaggaccgctgctgtaccgcggtttcctcgtcctgccgagagggtgctgcctgccctgcccagccccagggcgagggtgtatgcgtgcagaagggacttgggaaccagggcgggcatgaggctgttggcatttctgtaacggaggcctcctgcattactgtggattttagtgggggaagaattggcttgttttacaagtcagctttccttgttaatgagctttccttgttgctcacagcttattgtccatgtagtgagtacagttgagaaatctggctgttatttatgacaggggtacccaatccctgggccatggactgataccagtctgtgccctgttaggaactgggttgcacagcaggaggtgagtggcgggagagcgagcaaagctatagctgtatttacatcagctcccatcactcccattaccgcttgatttccatcttttgtctgatcagattctcacaggagcacaaaccttattgtgaactgcacatgcgggggatttaggtttcacactccttatgagaatctaacgcctcatgatctgtcactgtcttccgtcaccctcagatgagactgtctagttgcagaaaagcaaactcatggctccaactgattctacattatggtgagttgtataattatttaattctatattacaatgtaataataatagaaataaagtgcacaataaatgtgatgcgcttgaatcatcccaaaaccatctccccgccaggtccatggaaaagtcatcttccatgaaaccagtccttggtgccaaaaaggttggagactgctgatttatgacattatcagtcaatttatgggcccagagtgtcagacctgggccaggatctgcatgggccaggtgtcaccaggaagtcactctctgccctcaggaagctgagggtcttgtgggatgaacagccaggtcagtcggtagctgctgagcagggtgacccatggagtgtgacagacaggcatgaggttgctgcccaagacagaggaggccagagagggctttcttggggtgcagcccatgctttgttgggtgagaaggcaagaaacacatttgtgtgcccaaagcagggcagggctaaagttggaaatggaaatgaaggagcaggtagccatgcagccttgtgctttccagcaacagggtggacacttggtcccaagaggacgcagctgaaagaccctctggcagggagaacgtgtgaggactctgtggtggattctgagttgtgcctctctggcttaatctcatctgattctagcagtaactccaagaggtaagcacatttgtgagtcctgttttccaatggaaaagctacatgaggcccaccaggtcccagaactcaacaatggtggggctggggttcaaagccaagatctctgactgcaggggctgtgctctcagcctgtccctgctcctactctgggagctggtctggaagggtttggggactggctgagaaatgtgaacatccccaggggctgaggcgtgatgctggaagaggtgcatttggggacagtcatatccagctgtaatggacagggccaggagaggctgcaaggctgcaggtgggccactgtggcaggagttgtttgagtgtctggggattagaggattagagcctcaaccaggggtgtggctgagaggagggcgtggcaggggctcagagaggtgggggatccctgggagaactgagcctggcactagcttggatgtgaaggctgtgagagatggagaggcagaagtaggtgagggtgcttgtgatcacaaggcaatcgactgttcatttagaagagaagccgtttgaggcttcctgatgtatccttgttactaggcataaagcatgagcaatgccaacaagactggttctttcggaacaatagttaaatcctgggggcaggtgagaggtggggaatccccaccttataagtcaggcacgagtatgcagtgatgagttgagtttagttcagggtgctacagagttaggagtgtgtaggaagacaaggtggggctaagtgtggtatgcacgggtttctctctcccacctaccagctgggtgactccaggaagaggggcagcctcctgagccttcgtttcctttctgtccagtgggaatgtgatgcttcctgatggtctgttcttcccctgtacaccctccctggagcatggttgggtgacgtgcattacatatcgtaaggcgatgtttcctggggaggggaacatgtcttagtctagcacctacctaagtctgtggaagttaataaagaaaaaaaaggtttatttgggtcacaattctgctgactggaagactgggcaactggcaagggtctcaggctacttctgcttgtggaaggcgaaggggagctggtgtgcagagatcatacagtgagagaggaagccgggagcaggacatgccaggctttttgtaacaaccagctctcaggggaactagtagagcaagagctcactcaccaccacccccagggagggcattaatctattcataggggatgcaaatacctcccatcgggccccgtccaacattggggatcacattttaatacaaggtttgggggacaaatatccaaactatagcctatcacctatcactcagtggtgcctcctggggaggggagggttgggggctgtgtatcttatatgtcgcaggtgtctaaagcgtagatggtgtcagaaagtacttcccctcctccagccccctccttgggatgtgtcctcaggatctagagggagtttatggatgctgatttgggaattctgctggctggcagagacaggagctgaggatggacacctgcttgttttcctttacaaatgctttggctctaacattgacctggaaagacgccaggacagataccatggaccttactttatgtgtgcctaggcttgatctccttagaaagtctcactgaagacaagtggtggtggagcatctcagcagagctgttaaaattcctaaaaggcgctggtgtaaatacagctactgcgagaagttgctctgacacgtaagccctcagagagccgggcctctctcatttttcccctcttagggctcctcaaccttttttaaatttatttatttatttttaattttttttattatactttaagttttagggtacatgtgcacaacgtgcaggcttgttacctatgtatacatgtgccatgttggtgtgctgcacccattaacttgtcatttaacattagtccctacaaaggacatgaactcatcattttttatggctgcatagtattccatggtgtatatgtgccacatttgcttaatccagtctatcattgttggacatttgggttggttccaagtctttgctgttgtgaatagtgccacaataaacatacgtgtgcatgtgtctttatagctgcatgatttataatcctttgggtatatacccaataatgggatggctgggtcaaatggtatttctagttctagatccccgaggaatcaccttttaacaatgagaataatgtttagccccttggctgggtccttttctcaccttggtattgcagggttagagatgattaccaaaaaaaccacctcttggtttttggcttggtggtaagagcctcttggctgatgcctttcaagatagctgaaattgtcacctctccaagggatttgcaccctctctgactgagggactcctttgatttggagggaaaagtcccccaaagtctgtatagtgatagctggggcactgatcccgccaaataggaggctgaagttgagaataatagagccttgttgaccttggcagcttttccacagtggaattgcaggacccagcaaggagatcccacagagtctgagaactgagctcacccccgaggcgggaataggaactcgcgggcagctttggcacaagcccagaactatttttggtgtgtggtgtgttgactgtagggctctgccatttgtttcttctctaatgaaacaggtgattaccgtgttgaaagaaaggaaattgcaagtgcaagtttaagggccatcaaagggcggactggagttctcaatagattaaccaagagcaaatattcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcctggccgcaaatattcttaagcttggagacttcacgattccacagtgagtaactggaatcgccatcctgtgtgcagtcggcagctcaggataagaatgaaacttcttaataatggctctgcttccctccaaacaatgtgttttccatgatctctctggtctattaccaactatttgtggttggaccaagtatgaatgaaagaatgcacttagagtttgatagatgggctaggactggtttcagttttgtgatctggatatgtttttgcttcttgatgtccttcccttccccctacatcctctccagggctttagtttgtttgttacaatgagattctacatgatttttgtatttataaatttgcttctaaggtgaaccccactggctgtgggggatggaggaggcctactcttctcttgtgtctgttaaatccttaaggaattatttttggtccaggaaaactctgatgcctctctcttttttttttcttttactttttttaaagagttggggccttgctctgttgcccaggctgaagtgcagtaacatgactgatcataactcactgcggcctcggcctcctgggctcaagtgatcctcccacctcagcctccctgagtagctaggactacagcacaggctgcaacccctggctaatttttaaaaattttgttagagatggggtcttgctgtgttgctcaggctggttccaaactcttggcctcaagcagttctcctgcctcagcttcctgagtagctgggactacagctgtgagccacagtatttggccctatttaattttatttttctgtagactcttcggccaagcctggctgtttcccagtttacagctagtatttactcttctacccattcaaactttcaccttttctagaactcagccaggcagcaatgtgatggtaaaggtgtaaaaattggatctttgggagggggaaaaaagagcacttacttgtatcaactgccagtttccaaggtgtaaatactcccatcatgatcaatcaggctaccaatgtgatatcacctggcttgcagaacctctgcaatttaatagtcagccctggcaagctggcaaaaactgccactggcaccctattgagccaggaagtgagtttctaacttcccctttcttcctgtttctaatcaaggctgcaagttcctttagggtttcaaaggcacttatggatgatggtcatgacactacaactggaccattgcaaataaaaatgacaatggggaggtcgtaattgtttttctttttaaagcctcttcttagtcatcgtcttccttggaatataaatgaggaaggccagtttccttcacggaatcattttccatctctgttggcagtgggcctggacagaattctgtgttcttactcccagggctagttgttcctggcttcccccctcctttagtaaggacaaatgaacttaggtcatcaacttgctgcctaagccacattaaatcatcaccctcaaaagctgagggaagactgtgctaatcctgcaaagaagtctttactaggtgtatcaagaaggttcagagtcattttgcaggaaagagtaactgctggtgctactggcagggccactgtttgcgttttctcattccctccctcatccttcctgctgcaaacaggagatgttggcggatgctgtccattgacagggtggttggagaaatgaggatggtgtgctcagagaccccaccacccctgctagaaggaaagttaagtttggatggaaggggaatagagagaagtcttaagacaggagctgtcaaactatgaccagcagtagttgggacccagctacacttgctcacagatgccttgtctgtgggggactgtgtggccagcaaaacccagaacattttgacccttgacagacattgccaactctgccttagagcactgtgctgcactgaccacaggagtgaaaaggccacacttggagcccacatagcaggtcccccatggcctggtggtatggacgagtggggaggctttctgctgcccccactctccccactcagatccttcttttttttagttacttaagaatcatcatttagcatgagtgtgttaaatgagtttatttcagcacatttcagtgcatctgtgactcaccctagacattcagtgctctacgtgtgcccaggctggatgcctgtgcaagaagaccatgttgtttgtgacatgggtggtcactagttttatgttttagtgtctgactttagctctgtcttcctttcctttttttcccgctgctattgcattattcatttttccttttcccccagtttgctgctcattctgtagatacataccttggtgagcctcactggagagctgtggcacctttcagagtggagactggtgggggcagagcttaggaatgggtcaggcacaaagaagtagtgcagacttcttaatatggttggctttttccctcagtgctcagtgtttcaaaggaaagatgcaggccaggcacggtggcttatgcctgtcatcccagcactttgggaggctgaggcaggtggatcacgaggtcaggagatcgagaccatcctggccaacatagtgaaaccccatttctactaaaaataaaaaaattagccgagtgtggtggtgtgtgcctgtagtcccagctacttgggaggctgaggcaggagaatcacttgaacgtgggaggcggaggttgtggtgagctgagattgtgccactgtactccagcctggtgacagaaaaaaaaaaaaaaagaaagaaagatgcccttcacctctatgtcaagctcattggtagtgttacagctctctctgctcaatgtcagccatgctgagtcatggaagagtcagtaagaaaagattattcagaaaaaatttacagaaaatattttgagacattccagtgagggagtgaaggggagaagtcctgagcagaaggaatcgagggagcagaaaataaagacctgaagttctttttcaaagcaatttggaatgtcttcttcctttttccacatcttattggtgattgccataggttctggcatctagcttcagttttcaactatataggttaaaactgtaagtacaaaactatacttaagtataaaactataatcccccatatatgattttaacaagatttttaagctatacattatacttagggcttactactttaaaacatgccattactgtgtttatgcatgcaacatgatgcatccataaatctaccttcttgtaaaagggccatcccctttgcctccagcaagctaagtagcttgagcaatgctaaaagaacaatacacaccactcatcggtgtcccgtgggaataccatggaggtcaggccagtgggaacccagaagttaaattaatagcagaactgcttcaggagtagttctagtaagtgttctttatgatatggttcctggcatatgggatttcatttttccattttttccagaaccaggatagccatatttttaaaaaggatgatggcggagaaaagtggcatttttagaccaaaatgtagctaccaatttatgtagctgcttgacaaatcataggtacaggagatgcggtagaaccaattagaacaagacttctcagcacttgcaggtggaacatgaattgaattattagctctctctgatgcctggaccatatttgatataaaagtattggggagacttgaaggtttatatcctggcaaggggtgatgattggtagaaataacccccaggctaggagagctggtgtcttattcattatttcctgttttacattgtatttccccagtcatcccccattggtattgtttagtgtctgaattcttttatttaattcatttatttatttagttgtttatttttgagacagtgttgctctgtcacccaggctggagtgcagcggcacgatctcggctcactgcaacctcagcttcctgggttcaagcgattctcctacttcagcctcccgagtagctgggactacagacacctgtcaccacgcctggctaattttttgtatttttagtagaggtgggattgcgccatgttagccaggatggtcttgatctcctgaccttgtgatccacccacctcagcctcccaaagtgctgggattacaggcgtgagccactgcacccagcctagtgtctgaattctctccacttgaccgtaagcttcatcaggtaaggagctatagttgtgtttattgttgtatctttcacatgtagagaaacatttattaaatgttgaacatagtgatacaaggtgatctctctaaatgtggcatgggagggaagcctgttctgtgcaaagtctctgtgggactttcatttactaaaatgaaatcatcctacacacccaattaagacagggcttttatgatgcgttgagtgcctccttgttaggcttaaattgtgtgctttcaggaagccaaaacagcaatgaagactgtgatttgcaaacattgcatcattgggttacaaattcagagcttttctggagagatcaaaactatacattttcaccacctgatggggtctgactgttgggaaatgacattcctgttcttgcattatttctggtcatttggtgagtgatctcagagtgcagggctgtctttgttcagaacccagctatcaggagtgagatgaatggaaaaatatgatgacttcaagagccttgctaatgctagctagattcctgtgcttgcgagatgggctcttggcaggagggagagggcaagatgggctctcagcaggagggagagggcttccctgttcagagggggaccttctgcaacatcttcttacacttgaccttagtctcttcctacttctaatcttcggactgtaatgttgcccagactgactgatctggccgtaggtggtaagaatcttacaaatcgatgccatggactggcagctgctcaaactgaaaacctttcagtcaggagttcccttctcttgggtctgttgtgatgccttctggcactggcttctgagaggccatcagcactgttggcccttctcattgccttcttcacagtaggaattaagcctgaacagtagatctctgtcttcctggtgggcaactgtgttttttaagacctcagtgagagttgtctttggaaacaaatgaatggaacgctgcatgctggcctgttctctgctgtatcttcaggactcctgagccaaacctgatttcatcatcttctcgagggctcagtacacattgagctgtcacctgtggtgtgtggcctggaagaaaggcagctcatgagtttgcctaacaggactctcccttggtcactgagggctgagaagtggcactaggaaccaccactgaggcagcctttggaggagccagaattctttggagcaggattgctggtagatttgttagttgtaaggcccacatctcgtcatatgtactatttaataatactgagttgtgactttatttgtggttagaaaaccagctatgggacaaacagtgctggtttgtctctaagcatttaaaatcatttggaaagtgtttgtacttgctgagaggcgggtatattatttttgccaagttcatagtaccatccattggtggtatgaaattaatttctgagcccaccaagtttcaggaagggtcccttgctccatactatgatggtgatgatgtggctgatgatgctgtgctggtgaagaacacagctcagctccctgtggtggaggagggtgttgaattgtcggggaggaagctggagggagcttcttatctctgctctgtgctctcttggtcatgggtccattttcatttctgtagcttctaaggggtccaggctaaaggcataaagttgctttatgctgaacaaactgaccgagcttagcaagtaggatagctctccataagtttaatagggttgggcaatgtatttgaacatagcatgtgtttaattgttttcattgtttggctatatctctctctctatatatatctatatatataaccaaaatacatatgtataaaacaaccatacacacacacacacacacatgaccccccaaaatcaaataggctgatagattactcagaaaaagataagtcacataggaagtgggctatataaaaccagaacttccatgaacacagatgctccctcccactggcacctggcatgcatggcaggtgctttatattgaagtgcagaagtatatgagttttaaatctttaagagactttaatgttttacttgataacaaaagaaacatcacatcctattttcctgaatagtcctttatcttcatatggctcataactgttatagttttgataatcatggcattttggccaaaacactttgccagaaactataatctctacaagtttccttaggctatgaaggtgttttagaggattataattttacatacccctaataccatcgtcggctcttgtttccttatctgcagatgaacgagatgttttctttctctctcttttttctcttctcttctcttcttttcttttctcttctcttctcttctcttctcttctcttctcttctcttctcttctcttctcttctcttctcttctctcctctctctctctcctctctctctctctttcctttctttctttcttttttgaccacatcttgttctgttgcccaggctggagtgcagtggcacaatctcggctcactgcaacctccgcctcccgggttcaagtgattctcctgcctcagcctcctgagtagctgggactgcaggcgcacaccaccatgcctggctaatttttgtatttttagtagagatggggtttcactatgttggccaggatggtctcgatctcctgacctcaacctcgtgatccacccgcctcggccacccaaagcgctgggattacaggtgcgagccactgtgcctggtcaaacagaatatttcctaagggttcatcctgctccacagtctgaggttgttatttgttaattaaataaatatttgttgggcattgaccatgtgccaggcactggggctcaaggggtgcggatgacccatctgtttctctcaggaagctgacatccaggtgcacagggcatagtttacctgtgaacagagagggcgcttttctcccctcagtaagctaccttgcgtcaccttcctctgttcaaagaggactgataaatcacctcactaagcagctgttgcctgcaggtagcccacaccgggctgggtgctgaggcacagaggcacacagggcgctccccacaggaaccaagcccgggaggcacacctgcatgccaggtgctgggggctgggggagtctgtgtcctggtttggttcatgggcatcctggttttatgtagctcacttgctgtgtgacttatctcttcctcagtaatctgcagcacctagatcattcaggttttgttttgttttatatatatgtacattttttggtttatttatgtatataaagtacatacatcaccaaatataaccatattatggctgtatttgcttacatgtatttggttgttttggttatatatgtagagttgaatgtccttttatttccttgtcatatctatttcttatctatagcctgttaagaattcaaagtttttgtcatctctatacaaaatgatggctatttgttgttagtgactatgaatattcggagaaaattatctgcatattgacttgaaatactcttcctaacaaaaatgcttcccctcctgctccacgcttgcccccctaccccgacccctcactgctgctgggctcgcgggtatggtcagcgctgtggcttcgcccgcggcgggccagggaagtgcattagaacacggagcacagggagctatttccttctcgccgcccctggtctgtgcagagctgcctctgagacatttcctgtgcgggaatgaatccagggctccagggctgtttagtctgggcctttgggagttcggtgcagctaatgccttccagaggcccagcccctgcgcctggcgctgccctcctggtgcccacgctggctggctccctgccgtgcatcccggccacgctcacttgcagcggggagtggctgcctgccccaagctggcctgtcatccaggaatgaagatgttctatttgtgttttatatggattcactttgaaactcccattctgtgttcccataaagggcatgcatgtgccgagcccagccttgactccctcctttcgctgtggtgagcttgtttattttcagcgtgattctcagctgagtcgcccgtttcccaataaaaggcagggcccagcactgtgggctccatgagggcctgtttggttgcttggtttggagcacgagggaaaacttgatatgcacgtcatttcccagttccaggcaatgacctggggcagagcgggtggggagcaggtctcccggagccatctggaatatgccgatgagtgagctgtgcattagctctcagaccagggtcctctggcagccaggcctctgagcacagcgtctgaagtatcagccgccacagggatctgtgggcaacagctgcgtgtggcctgtgctgtttctctcctgacaaggaccttgcaaacagcgtggaaatgcgcgagccagcggtcaaacccctcttcaccatgcacggagctcagccgtcctctccctgctcctggaggtcttcctttttctgtgactgtaacctaaaaacattaaaatacgtttattgagatagcaaacttttatcctcttggtgtttgcagtgaaaatagtccttaatggtgtaattttcctttcttacctccctccgcttgtcccgtcctagctcttgttattccaaacagtgtggattattgggctgcacctggccacccaggctggtgttttgaatcagcagcatcacctctccggagcccatagcaggaagcaattgtttgggatctgatactgctgggctctcattttccttgtcttagaaatggggacacatgtctgcccatgttgagctctggcagggatgctggactttttgtcctagctaagaaaccaaactgcatgtgggttacggaagtggtctaagtttcccagtgccagcacgaagcctcgactggtgagtattgtagaagagcactgccttagctgagtccagtatttctcttccaaaataaacgtgcatgttcaaagcaattgcttgtctgtgggtataactgttgtgtgactggtagctgtgggaacacactgagtgtcatgtatgaccttgcgcttgtcttcacgcagatgtcagtaagacttccaaagtctgtgttggtcatccctgggtggtgggatttaagggaaaattttactttcttcttcatgttttctgatctatttaagtttcaataaatgaacatctttttttaactcaaattttaaaaatttgtaacttctagggctttggaatctttttttcttcatggaaatcgaacacagactgagtcatggttcttagaattctgtaattatcaagttgaaaagaaccttaagaattgtctggctcagaacctgggattgagatgagaggctcctgagcctgcacttgcgttttctcctcagactctccttcctgtgctctgcccgttatcaaccgagccgtccctgcctgggttgtctatcgtgtgactgtttcagataaaggcgggttatcttggtttggaagaattcggataaatgacatagttcttcattgcctctccagttgactctgccttacccacaggcagatttaaggctggggttggcacactgcctgcaggctatgtattgtctgtggctgcctaacaacagagctctaacagcagagctggtggctgcggggaaggccacacagaccccgcagcctgcagtggttaccgtctggccctttcatggacccctgctgagactcattagacagtgggatgtgagcaggagacccacggcaaagacagtgaatgtaagatgggaaatccgctgtctggaggggcagtgtctagggggaccagggactgtggtagcctgcctgtggtgtgtgctgtgagctcagtgtcggcccctgaccaaaggcatgcgatggggctggaacactgccgtcgtccttggaattggatgttcagactcagctcttttgctgttgcttcatctggaatgttctcattaggaatgtgaaatccggtgtgggccaattcttatgccctttaaagcagatgtcgggttcaggctgtgggcactgagtcctgagactggcattggtggcggaaagcactgggctcagtccttgattcagagaacacacagcagtgcggtttggtggctgctcccacagtgtccccatagccttccttgcctgtgcagtggccccagtggcttcaggacagcagggctgtgccatagggcagagcctcccaaccagaggctccaggatgttgtggagttcatgaaggtagccatggatgtccctggccattttactgtttcgaagagtaaggtggacatcacagttttatctatgactgggaaacacaggcagagagaaggactaagttgctttgttttggcaagaggggagaggaacagacatgtggggatgcttcctgtgtaccagactgggtgctgggtttttgacttcctttcattttttttctataccatacctcatgcagttggcagccaatactccacagctggggcgtgggtgggaccagagtggtgccctgatcagagtaggcaccaggccacactcacttggctgctgccaggcccagccagggcaacgggcagtcctggaatcaaagcctgtggtctttctacaacaacccatggtgtctggaattccctccattgtggctatggtgttcgtatctaggtggctgaagccttgctatgtttgataaggaacaggaagataaatggttaataaatgtaatatatttggaagatgatattttcaggatagggcacatgcactgaggtgggagattttaacccagcgtctttggaggaaaagttggaaatgatgccttgtgtggctcactcgctggagccctgctggcagacccatgagggcaggggcttagcgtgcaagcttcagggataggatagcaggagcacaggcagtttctttctgcccctctgtcaacatatttcagattctcttttaggcttgtctagcactgatgtcatctaatggggagagtccttgcatttgccttaaatagggtatatttaaagagtgatttatacctttttccaaaacaatatattgcccaactgtcttttggcttccttgagtagcctttatttgagtcgcacagcaaaatcccatatttaaatgattttgagatgctgctaagaagtgcattcatgcctactagtagtcctggtcattatcagtcccactaaaccgggacctagtcctggtccagactagaaattggagtccatcatttcagagtcagtggtgacgtcagtttggtgccatggcctgtggtgcttcctgttttccttgcctggcacttgtacttcatcctttcccctattggcacgctaatctttgcatggttttatcttgatgagatgtctgaggggtttgtatttcatcctgcagcacagaaacaaaggttagctcattgaaaagcaaacgctggtgaattcaggcacacttggaaataaatgcaaactttttggcagtcgtctgtgtaaccaggaagcttcacgagttggcaggtggtttcacatctgtttgttcctttactcaacaagtattaactgagagcaaacaaggatgagctcatggctcccctgaatgagaccagcactgtggctgctcaggtgcaggagctgcaaatctgaaatcttaggttattgctttggctgaaaagtgcaatctcagtggaaaccttatttttaaggatctccagaatcagtaataggacacattttgggttacctcaactaagggacttttctaggtagagtgtacataaaaatgaagtaagtaactttgaacagtgtaattgtaatctattggcttcaaagagagtctagagtaaggagtaattcatcttttaacagctgtaagctgccatgccagtaatagttttttaaacatgtcttttagttttgcatcttaattatttattgggtatgcactaattaatttttttccagggagttctttgaatattttatagtaatactttatttttctggatcacttgtgctgaagcagatcagagagcaagcagaaaagatccacgtggtctaattgatattctgcatgttatatccttgagactctgtcttcactgggggcctagctcctttgggttttggtcagcacactggaaagcctcattctgtccacctgcatttcctgggtgtctgccctttacttggcccagtgctaaatcttgaaaattcaaagggtaataaccaacatacaaccagtgggggaaaagcagacttgtgcaatgattattttgtgattcttgagtcaagtagcaattgtagagtttaataaaatagaaaagggtacagaggaggaagccaattaattgaaaggttatttcattgagggctggaaggaggtgttttgagagaagacagctgagcagcagtgagatactctgagagaacaccatgtgcaatggaatgctgtgtttttaggagcccaatagttgctcacaatttcttgatcaaaaggcataggggccagccatgatggctcatgcctctaatcctaacactttgtggggccaaggtgggaggatcacttcagtccaggggttcaagatcagccttggcaacataatgagaccctatccctacaaaaaattaaaataaaaaattagccaggtgtggtggcacatgcctgtagtcccagcaacccagaaggctgaggcaggagaatcgcttgaacctgggagtttcagatttcagtgagctatgatggtgtcaccgcactctagcctgggtcacagagccagaccctgtctctaaaaaagaaggcataggggcatggaaacaggaatggaggctgttccgctggcagaagttaggctcagccgtgaactttatcttatgtgacacggcattgttgaacagttttcagcccatgatgtgtatttaggggagaaagatcactagctgaaggatagggatgcatttgtcagggtgagactggtggaaaggagattgatcacttgggagatttggcattttaggtgaggtatgatggcctcaagagagccctgcactggggtgagcaggcttttccccagctttgtcagccacctgctgtgtgacctggtggaagttacatttaaatgttccagagtctgagacaataagctctgtttactgggaaagtcactcgtgtggtgctgagattagccatctgcctttatcttttctttacagacacactcagcccagagtcagaataagggggactgtgttttcagatgcaaaaccagggacgatgatagctcctgtgcaggattgtgaagcaggaagattaaatgccaggcctggggctggtgcagagaaggagcccaatgcatggtgattttcttttatatctactaagaaagatacttagggtggtacaagggactgcaactaaccaggctctgccattgtagcatgaataagttggacatgaaatagtctggggcagagattttttagacttggggcctgtgatctgccagagggttcatgcatggacttggcagctccgtgactccttggaactgtgtgtgaagccactatttaacttctctggggagtgtgactgtcacctgctctgggggggggcaccattcctacaaagttagtatcagtggtccagagaaagaacaaggccacagggtgttgaggtgagggtgagggtgaggggagagatgatagtgtctagaccacacagagatcctgcttgtgtagtaatctaaaaactctgaataacttaggacaggtagacttcccaggaaaatgctaagaacccccttcaacttgatcctctagtagatttcagatgtaagaaatattaaagcctattagacaaggcaatttgtttgatttattctggccaactgccagatggcttgtaggtcaagaacaagtaaagttgtttgtttaattcacctttctcctttgaggtaggatttctccattaaactggaagtttctagcaggagtctcatttgatttgccaacatgtttcccaaatcatctaacataatcagaaaattagacctaaacaaagggcctaaatcttttctcccaattgttcaagtatgtttctttgctaaggtataagcaaacaaacaagtctaccctaaaactaaaaatattttctctttctatatccatatcaatctgtgctgctatacaacaaacctaccctttcttagggtaaggaaaaaatatgaggcaccaatgtaccaaacaaaatattttcatatgtatttcatacattgcagagtcatattctataaatttcaggaacttagttgtcaacgtttttatctgcctctttgctttaatttttagagctcttttatgaatgttctctattgcaattcattgagcccccgtgaataatactgcttctgctagaaatgatatatactcagtgtggtggaggaatattggtggtatgctttagtttccttttttttattgttttgtgagctctagatggtctcctgtagcaggtcctccagagatattatacttggatagtttatattctctaactgtatttgtcagagattattcccaacattgctatgttttatttatgtcaactctttaacccaaagcctttggactcaaatacgttatttttcagaaccaaaagagtctgtggtgagacagcaaggcagggcagttggcttatttatggatcatgctcctcttcctgtcctcccaggaattcactttgtcaaagttcttgtgtcgttcacatagatctaattaacatttttaattggtgtgtcgtgtagttctggaaactgcttattagatttcgtaggtgtctctggcagcacaaaatgtttaatgagcaaaataattgtgttacagtgaaatgaatatggacatattcactgaattaataaatgaattaaatgatgacttcatggaaacctcctgagaaagtagttatggaccatcttccctgtgtaagatattcaaattaacttttcgtgtttgtgtgaaggttttgggggaaatactttttttcttataaagtataataatgtgtgtgtgtgtgtgtgtgtgtgtgtgtgtgtatttttaaaccagaatgagagtctgtaagtaaactgagattcacattctttaattgagcctcagaagagtctgtgaaatgtcatggcagctggaaggaaacgagtaggatgtacaatgtccctgaccagagaaatacgtatcttgcagctgcgtggaaattgagataatcaaaattaggttctacttcctgttctgacatgtgatcctttttatcctctgattctggaggtgatggccaagaagtaagaggatatataaagaaaggtagtctgtagattttcagagctgctgacagtgagtccagactcttcctgtattagatgaaaaagcagaacgtgagaggacatgacttgcccagagtggtggctcggagctggggggtatccctgagatctcttaactgctgcccagcccagtgtccttgtctttgtgtgttttctgttgctataatataataccaaagagtgggtaacttataaagaaaacaggtttcatgagctcacagttctggagactgggaagtccaagaacatggtactggcatctgatgatatccttcctgctgtgttgtaatatggtggagggtatcacatggtgagagggcaagaatgtgctagctaaggtctctcttcctgttcttctaaagccacaagtcccatcatgggggccctaccctgatggctttatctaatcctaattacctccaaagaccctgcctcaagatgccatcaacatatgaatttggagattgtgttttcaacacataagatctgggggacacattcaaaccatagccctcttggctaaaccacgctgtctcttacccctcaaagtgctccttatcgcaggaaaatacaggggtcaaaaaagtcactgacgaaagaactagggctattaaacaagacagaggctggatcatttggacccaaaggtgttcttaaaaagactctttgggttgcaagaatcagacccattcaaattacctcaagtggtgggatcttattgtaaggtttgctctctgtggggacccaggcacagctgaacaaatgggcctccatggggttaggaaccacaggagaagtttttttttttttctctagtctgccagtcacacagctgggccctgttctctgtctacttccctctctacctgtgctgccactgaaccactgccctccactggtattccccactagtcagggcttcggcctccttcctttgcccacaatctctgcttctctctgagtccgctgcctttcctgatttggcagatggtattgatgactttttctctgtttcctgattccatttcccaaaagggaccatctcattggctcagggaattacttcacagcaggtacacagaggccattagctagccaatgaactggctcctcaggggtcaggtgacttcccctggcccagtgatatggtttggctctgtatccccacccaaatctcatcttgaattgtactctcataattcccacgtgttgtgggagggacccagtgggagataattgaatcatgggggtggtttctcccatactgttcttgtggtagtaaataagtctcacgagatctgatgattttataaggagaaaccctttttgcttggctctctttgtctgatgtcctccatgtaagatgtgacttgctcctcctttccttccaccaccattgtgaggcttccccagccatgtggaactgtaagtccattaaacctctttattttgtaaattgcccagtctctggtatgtctatcagcagtgtggaaacagactaatatactcagtcagctaagagtgtggtcacaggggcttcaggggctgagtccagggcaagcttacttggaagggaccaccccatgcagagagctctgcagtgggatttatcagcagatttctccatgcaatatgtttaccctgatgcaagcttcctcagattgataacattccaatcctacttaccaattttccccttcttgacaaagtcctttgatggccagcccgctgtgcacacacagtactcacagaccctccgtcagcatgagcatgtggaggtggtgaggagaagtgatggctcaggaaggtccttccagctcgtctgtgtttggtgttggacttctgtgtcagagtttttcaaataaacctgttatttgggaatgatcttaggtttatggaaaagttgagaaaacagaacagaggattcctgtataccccttgcccagtctccactaatgttgatatcttatgctaccatggtacatttgtcaaaactaagcaattaacatgggtacattactgttcactaaattacaggttttaccagggtttcagcagtcttgccactcacgtcttttttctgttccaggatccagtctagaatggcatgttgcatctggcgctgtaagggtttgtgtgaagaaaggattccactggtgtaacacacacacacacgcacactaacaaacacagcagaaaagtacccaaaagtttctttatcctctggtccatgccacactcctactttcaccagattcctctttattaaaagttatgtttttaccttcccctccagcataaggacctgcagtagatgcctgttgccgaacacaccaaatccaaatttccctcccggccacagggggttcctattctctgagtctactctcctgcctcctctttcttctccagccatggtagtggatgctaggttccatctgtctccctgcctttttcttgacatctctgagcatacttcatccatgccacattctaagaccatttttccatgacctacaccttttttttccatcctggcaggaattaggtttatgtgttagtatattctctggttttccttttaggctttactgtagttatattgccatggctgtaagggccttgaatgagcaaccaaaggccagtttggtgatgtttgctcattgctcaggggaggaggagcctgattttgaacttcaaaaaaattatctatgtgataaacatatgtatgccgtaaacctgaataatttttgaaaagtaggtaattgcttcacctgttgaagcatgaagaggtttgtcttacttagttttctgctgctatagaagaataccacaaactggataacttataaacaatagaagtgtatttgactcatgattttgaaggctgggaagtccaagagcatggcgctggcatttggtgagagtcatcccatggcagaaggcatcgcatggtgagatagtatgtgtgcatgtgagagaatggggctgaagtccctgcttttataactagcccactcccatgacaatggcattaacccacttaggaaggtgaagccctcatgacctaatcacctcttaaaggtccaaaccctctgcattagggatcaaatttccaacacataaactttgggggacacactcaaactatagtgtcccagaaaggtgtctgcatagtataatctcacatagtcaggtgtttttcttcctggatgtgcttgggacatagaaagcacatggaacttgcacaggagatattttgcattaattgcaagaatgaatcgatgttgcgtaaattggtgactaaaggaatgaatgagtgggtaagtaatggctccagttacattgtaatgctttgaggctaggctggtatttccttgatatcaactactgcagtggtctacatataaagtaattctcaatttaaatgatttcttatttttaattttaaaattaaagtgtcaggccaacttggatatttgaatttctaggaaatagaatgctcaactgcctgtttctaatatatagtttatttccatatgcatattgccatataaaattatactgtttttcactctcatatttcataaaataacttaaacgtttcccatgaatctttgacattggtgtcttcatcatcacaggaccccattttgggtctcctaacaggtttcagagctcatcatccttccacatgactgtgtcgtgagatgtattttctagtcgtttttatcccaagccacaatgactaatttattcagcactaaaaattaactttttaaaagaaatctttagaagattgtgtacaaaactgtccagcactgtccaaaactgacccagaattgtgggtcattccttctgggttaattactgaatctgtgttaacttgccttcttgtatactgattctcaaaaagcacatcctgagatgactatcagttgagttagtttcaggcttgtgtattttctccatatactgctttcgtgttcttaataaagtaactgataagtgctttgcaaggtgagagtctacacagggaaccaaagagatggtgaactctcccttgctgctgggtgattttggaaacaaagctctaccttatatctagatgcatatagtagttcaactcccacacagtaaagatctggaaattgaagcctggagagggagaggtttcagtggccttttgaaggctgtgccttttgtgtataaaccaggactagaacatttgagtcttaccccagctcttcacaattcagccttaacttttatttttgagataaaaaaaatgagaaattaacttcttttatcctgcccgtccactcactctttgattctgaaaatgtacagttcatccctgaaaacaaaaacaaaactgatgagtctctcagcactttcctacatggagcatttgatcctcccagcagctcggtcaggtcaggaattatttatactctttacatataaggaggtaaggccaagggggttaagttacctgtccaggggcccctgccaggccactgtgttgtccctgggccattctctctagggcattgtcccaaggaaagtgggctctagaatcccagagacctgtgcccccacacctaccagttgcaggtgagtgccccagctcctcagagcctcagttattctcttctgtagaatggagccctgtggtccttagtggggttgagtgacacggtgtgtgttgagtgctaggtgctgtccagggtatcacgatctctctgtgaacgtggggtgttgagcccatgtggtggttccatgtgcttcgtagtctcctgcatgtgcttcaaggcactgccccagttgccttggctggccctgtgatgcttgggtaaatccatatctcctcccaggtggtctgaatttctacactcccttgggagttctgggagcttcttggataggtgactggtcaaagcagtgttcaactctgttccttctcccttacttcaaatgaccaagttcatatccttgttcataaaaataagacgtttatcgcacaaaggccaggagtttcctagcaggatgaaatgcagaaaggcagcttttcaggtgatgaaagcagatatgtcagatgtggtctttgctattgctgtggcggggccctgggggagctctggtcccctgtctgtcccagccgtgggtctgctcactgctcagagtcctgtgcggatagagctgggctgggaggctgagctgttgcttagctttgagcccctctgatccaggttgttggcttcccccatccagtgctggggtgctcctgtgcctccatgggcttcccagagagtgagctggtcccaccagaggtcccagcccacactgggctgcctgcttccccctgccaccaggaagcagcctctccaagtgcctcctgtgaatgtgcagcctcctattctgccagaactttctggttgggtttgcagagttcagggagttgtgccacatacaagaaagtatttgccaagcccaatgaggcagttacgtggttgtccagaaaactgagcaaagacagtttgtcattgaagctggtccctcagcgaaaaaggcctcatcaaacaaccaagaatgtaagaaaatatatacattttccatttatttccacctgaaaaatatgaaaagaattgtaggtgtctgtgaatatacccatattgtagcaccacctacctgattaaaatatggaacctgcttattatctgtttgtgtatttcgattccctttgttggggctgttacaccgtggagatagtaaaatgtgattagagtggaatatattcatttgtagacagtttggattgcatctgagatattttcctgattgttagaatttctctcccattgggatttaaagggtggttatttttccgtatatttatcaagtggaagaataatttgacagggacatgttatcaggtaaggcatctttcctaatcgatgtgaataaaatcccatgtaagaggagctcagtgtgtttgcatatttttttaaacaataaaagattggattgttagagcatcagagaagagtgaagacagctgtgctttttatcacagggaacctaaagaaaaattcttactttaaatccttgatccgaagaggcaagttaatttaacaaaataaactcaggacatcacatttacttgagtcacagagcatgttgaaaggtgcagacatcacagggcatcaaaggatttcacagaatgctgggggtggagtctctgtctctttggccaggcgttggttttcctgcctttggggttggcagagaagccggagccaagtccctggacaggacagccctcagacactcctggttcaccttagttcactaggcacatggctcttggtggaaaagacgatttctggaaaggaagtgggagactttagacagacaaaactcatccaggattttatattgtgatttcaaattaacttggcacactaatacttcagttattaatcttctgtggcactgtaggagaaatgaggcgacagtgtcttgtaattaggggcattcttgtgcctgtcaaaggggccaagtcgggtggtgtggatgcatcctcccccagctcctgggacggctggccctgtgccctgtgccccgtgcttggccagcagaggcctggccttggctgtcacgagcacatttcataccattctctgggccgtttttattcccttagtcactgggatcctgttttgtatttaacccagtgtcttgacttgtgttgtacattcccagggtgattttaacttcaggagagggcaggccctgtctctgtgtccttgaaatgctccttttaataattttcccagcatttgaaaatgtcattactgagatttctgtttttgcctcactgaaaagaagacgaagtgaactggagtgcttcccgtgtacgagatgctttcctttgcatttgcccagatgaattcatgtaatcctgactgcagccctagtggcaggtactgccattatccccatcctgcagatgaaaatgctgaggcacggagaagttgagtatcttgtgtgaggtcacatagcattaagaggcggagcctcgatacgaacctggggagtgaggctttagagtgcaaacacttcaccgccgtgctggaccacccgtgggagttcaaggtgtgtgtaaaatgaaagcatgtagggccagttacccagaccttgatttagaaagtcaattctgtttttgacatttccagcaaccagtaaagcaaacaaataacctcctgcccccagtttattaaaaaacagctcctgttggaatggggttttgggttgggatggagccccctaggaagaccctgcgggaaatgcatcttactagcttttctcaaaggagccacacacacagctttgaggtaaccatttttcttggggtactctgaggactgggcagcatgtgggaatgcagaggctccagtgaatatcactgccttaggttccacctacaaccccagcaccagcctcacctccccagctatggggtcagagttcagtttcattttcagtaaatgtgtgattctgtgggtccatatattcacccagtttatagcaaaaaagcgtgctagaactaattggaagtgtagaagccatgatgctgcctccccaacctgtgcccctagaagtttgctcgtctcccagaggcggagctgggcctagccctggcaccccaccccataggtgctggccccacctgtcacggatcatttaagcatattttgctagcatcatgaccacactctttgctggctccagagccacagggtgagggacacaggactctgtccccacggtgctgaccacttcgtcgtcattacaagaaagtattcccaaaggcatcggtttacttgttatcttaggttgagttttaaaatctacttgaaattcctataattgcacaatttaaaaaactcttcgatctgatgtgacctgtttagtcttttctgtttagtctgaattaggaaagctcttttctccagagtgcaaaagacaaccacagactttttttttttaaaggtattatttagaaaaagctaagatggtgcttaaggccgcacacacgtaaatacagtcatgtactgcatgaagacgttgctgttgttgacaattgcatatactgtgtgataagattatatctttactgtaccttccttgtgtttagatacaaacatttaccattgtgttccagctcctaaggtgtctagtacagtccatgctgcacagctttataggctaggagcataggctgtgccacatagcctaggtatgtcttaggctatgccatctggagttatgcatgtacactctgatgttcacacaatgatgtcacccaaggactcatttttcagaatatattctccttgttaagtggtgcatgactgtgtatatatgtctgtatgtccacacacaggcacacaggtgggcttgcttccgacttccctctgacaccatcctctgccattgtgaccaggaccccattctcagcttatcagcacggactgggtgctctcttcctgccgccgtcaccgtgggtgttaagcctgcctgtgttgtgcctgtcaggactctcaggaacccctcagagcagcccgtctttggagggcggtagggattgtaaggaaggggggcacagcgggggttgcctctgctccatctcacctgcttgggtggagtctgcaccggcttgcagcccaccccgtgagcgtagtgagtggtcccgaactgcagatgtgtgctctgtgcggtgctctcggacatctaatgagcatgggaaacaaaatatgacttacagcagtgtattgacttcccaagaaccagaccttgctccctgggcccgaagggctttcctgctgcagctttgccatgtagcaggggtgcctctgaaaactccaccgccaccccagcagacaactgtgccagtctttctgtgggatctgggacacagaaaatggaagctgtctggcctggagcgtggtctcttggtcctgtcttcctcacagtgatcaccacctccagggttgcatgggaggctgctgctcagcggggtctgggaccccatgggcccagccatccacacaacaggtgtggatgaagcatgcgcattgtttccccctggggtttgtgttgtccctgggtttggctcttggtctggatgaaagagaccacgttcagagaagcggcatcccccgtcattgtgactgcatccctatggaggggcaggggtcccgtcccctctccggcagcagtttgcctatggtgagggtgcagtcatccacctgggctgcatgccgagggctggaatgcaaagcgcttgggtttgctcctgactttgcaagaccacctcccaccacgtggtgcttgccgtcagtgtgtgctttgagactctgagagacaccatcgcagaagccaagcgttacactttggttatttattgacatccatgaacagattaaaaactgttcctactttctagggtgcttctctctgtgcagttgccagggggaacgtgttcgctttgccggggcattgtgtagcagctggcatttagtctcacaactttttctttgtttaattaaaaaaaaaacctgaaaatgtttgtgaagtactcttttcatcttgtgaaatggaagctgcttctgagggaagcaggcagcctctgtcttcaccagccccttccaccctcccataggagtccctccagtggaaacccactcactccccctgaagccactctctgagagagatgcctccactgccttgctagcagaggcttccccaggctgtgacctcgctgacagtgttgtgtttcttcggggatggaaaatgctgcttctgatacccccgagatagaggaggctctggtgtgttcagaaggaggtggcgtgaggtctggccaagcttgatctggagttacctggccttggcattctgattgtcaggctccacctgacaccccccaccatctaccaggcagacaggagaggaacttacgtgttcagtcgtttgacttttttttttttttcttttttttgagacggagtctctgtcgcccaggctggagtgcaatagcgctatctcggctcactgcaacctctgcctcctgggttcaagcaattcttttgcctcaacctcccgagtagctgggattacaggcacacaccaccacgcccagctaatttttgtatttttagtagaagcggggtttcactatattggaaaggctggttttgaactcctgacctcatgatcttccctccttggcctcccaaagtgagtccatattctctgttttaaaaatttaccccctatcaatttaatgtattgtgtaataatcaaagttgaatgtaaaagcccattaaaaatagcttttaggtttgcatcattatctgcactgtctggagcttcaagcagatcttttacaagttccccaacagtgagacccacttctcaacactggtcagagttctcaagccgacagtggccagagatcatggtttaagcacatccagtggttggcataaggttggagcgatcatactttctgcacttgattgcctaatggatgcctccatgaggttggatgcaaactctgtgtggaatgttcccctggtgtttctctaacagatctgctcgtggtttatcatggaagaagtctacagaactaaaaaggagaggaaacttccaagtgctctttgatgttgtaattgtcgttgctttaaacttttcccgtgatcatatgggatgattctgtgtaggtgaatattaacaaacactgtgataagaatctttccctctattacaatcaccttgacatcctatttttttttttttgagacggagtctcactcttattgcccaggctggagtgcagtggcgtgatcttggcccactgcaacctccgcctcgcgggttcaagtgattcttctgcctcaacctcctgagtagctgggattacaggcatctgccaccacgcctggctaatttttgtacttgtagtagagatggggtttcgccatgttggccaggctggtctcaaattcctgacctcaggcgatccacccgcctcggccacccaaagtgctggggttataggcgtgagccactgcgcctggtcgacatcctatttttatagattgtttccgatgggttgtaatcttccaaaatgttgattgtgtttcctgtggaattgtataacacctgagtgaacagattgttaatgaagatgggtaaattaccacactcccattgcaactaattatattgcagcgacttggtgaaaatctttcttattgtttcatttctacagtctatgtgcatttaaaatcacctgctgatggtcttcaaaaaaatttgctaggtgttgggtgtctcccttcttttcccagtcacatgactcacacccatagaatgggatcactcataggtgttgcatagacccaggctcaaattaatcatttttaaggagtgttcaattcagaaaacatctggttaagcacttactgtatgtaaagcactgtgctctacctaatcagaaaatatgaagagtattgtgatactttgcctactagatgccaatatttttatgggggagataattctaattcattttaatagttgcgtcaggcgaggagttagcacattgtttctgtaaagggccagagagtaaatatttcaggcttcttgggccacaaagagtctaacctcctctgttgtattcggaaagtagctgtagacagcatatcaagtgattggagagagatccagagggacagattgccaatgagagtagagggtccccaacgtgctatcaaccgggtaggaggaaggatgcagtgatgccactgggatgggtgacacctaggacatgtgcttaaaaaagtggacgggaaggttgtttctgacatcaagaggaaagggagttgttgcaaatggaaagtaagtgtgcaatgccctggagaatcattaggagctccgtgaggaccctggaggggccttgcagtaccagcggaggtgctggtcagcttagtctcttgcatacctactgtgaatactatttagaagaaagtggggtgagttataaatcaatgtgtttgggtgcggccaggctgtattgttgagtgattcatcttccatcctcattctcacagcctgggaaaggggtagggtgcccctcctgagagtctgctcaggcttgacgctgcctcccacattatgtgacttgaggggcaggcatttcccaccctttcacatgaagaaagtggaattgcagcaagagcagtcccaataattggagccacttgcccatggcagtatagctgggtggtgtgacagtgaggaccagtgcgtttctccttgaggtgctgatgcgaggggaagccctgagccaggctccagcagtcacagggatcacagtcacagtcacctgttgggcaaagtccccaggttgggactgaggattcctcttctttgtggttataaaaacaataaccctttaaggtcactgagaccagcatttttgaaacctttactattattattttcaacagaagacccttctgcttaacaaaaacagttgaaagtggtgcttctcggattgacaaaaagggcctcacactccagcccctacaaaccctccccctccacctcaacccctgcagtcattttggcgaacacaatttgaaaagcattgaatttgtctacctgcaccttcactttgcaaaccgagcgacagaagtcaactttggttaattttggactcagagttcttcacggtacccaatattggttctttgagagcggttcggttctacatatggcactaactcgtccactccacaggctactgaacctctttatgattctgtctgtatctaagcagggaacctgtccctggcactgcagctcatgggatgtttggagaaatcgtggcttattggaaagtgatctgagatgcttggatacaaaaagcagaaaatgagtttttaaaaacctcttcttttgagcaggcatcattctcaaaatgtggagtatttatagcatatgttactcatagaagacattaacttcccaattattaagaggaaatgcacttttattattagaaatttaatttgtattagcctggtatacatttgtgttggatcagagtaagcctttcttatagagatttggtaatttctatgcctgtgccagcgtggtcctcatgtggaatttctgtcttgaaacggcatggaatagtctatgagataaagagagaagctggaagtaaatatacagaaggtaatgcaaataggccttccaactgcagaggaagactcttatagatgactgcatttttcaaggacttaaattttaaaatctggaaacttatttcagtccctggggcttccagtgcagccacccatggaagtcacagcagtgacagacgagttcagactttgacaaatatgaatggtcattgggatggctttgattcaccatacatttctcctgcacctgtttctgtgcactgattttatgaattttcaatttatgacattccagtgatatgccagttactatcatcatagctgtggttaaattaagggtgttttgcaagaagaagaggtattgtgatgaacctcttgtgacttggaaacctgcaagttggaaaagttgtaatacagatccatcaacagatgtcaatgtgccaagaaattacttagtgtggttcaaaggtgagtaaatagaagttaaaattatgaaggaacattcttaactcacagcagttggattttgaatcccagaggaaaggccagaggtctcacattttaagagaactggaatcagggcaaattgtctgcccttcctgggaagatcagctgagtgagtgagagagaaataggttcctgtcatttagccagcatttacatttttttcttttaaggctttattgagacagaattcacataccgtgaattcatccattcaaagtgtacaattcagtggttttagtatattcaacatataatgtgtagccatcgccacagtcaatcatagaccatttttatcacttctaaagaaactgttctccttactgtcaccccagctctgggcaactctgtgggtctccctattctgggcttttcatatgaatggaatcatacagtttgcggcctttttatatctggcttctttcattccccatgatgtttctgaagctcacccatgtggtatgtgccattcatttttttaatgctgcatagtattctgttgtatggatgcaccacatttctttctccattcatgagttgatggacatttgagttgtttctacctctacatttaatgatggtctagaaagatcagtatgtagtatacattctgaccccaaatcattatttttctcacaattaaagggagggcaattaaagggaaaagaacatttgtgcagtgcttagtgccttagaaagggtgttttctacccagcacctgatttaagtctcgtctagccccggggatgggttttctgataatctccgtttacagggtttggcaggctgcaagccttgccccaggtctcctggcagggaaaaagtgaggtcagttggaatccagctgccatgctccttctggggcaccagagtgagtgactgactgctgaaaataaacttttgaaagttttagaacagtctgttctgcctgtgtgtgtgcacagtgtgccaaatctccaggtcaggatattctgataaaaactccccaagacgctggatgcatgggcagttgctgttgatggagtcactgtctcacatgtgtccaagcccttcccagcactggttggaatccctgaaacaggcacaggcactgcccgtgcagaccacgtttcaggaacttagcatccatcagcctcatgacacaggtggattcgtaacacagatgccggtcttgtgtttcttacctgcaggggactttcgaaagcttgggctgcggtgtccccagctgtgccctgttcccctgatctgtgtgtctgctgccacccctgcttcccagtgggctgggcctcaacccctgccatccacagtcttcagctgcgctctcggctggctgatggcagctgtgttgaggctctgtagaatggagaagtcctctgacaggtgggtggtgcgcatctgaggaggaggggcatttgctccagcagcactgaagggcgaggagcacccccactttcagggcccggcgggcgggctgggtagggagggcaggcacatatgcacacacaggcactttgtatcttctgcatatacaggaagagatgggtttggtgatcagcagagcttaggtttcatcagggcaggtgctgagcttcattccctccaccctaaacactgccctgcaggccggggatgcttccaatcctgaatgctcaagctctgcccagaatgtggttgtcagggcaaccaaaattcacaggacgaaaagattgagaagcttacagtgcttgacatgccatatagagaacccttagcttgctacaaactcagtttttaaaaatgctacttggaaaagaaaaaagaaaaagaaaaaaatccaaggaagggagaaagtagaggagctggggagggaaccccaactccaggatccttttttgtggattttgagaacacacagctttttagaagtgggggaaatgaaaatggaaggggaagatggtgtttaaaaggaatcctaataccctggttctttgactgaaaagaagagcattttacacctatatttgtagctggcagatggataaaaactaataggaaaaaaaggacaatttggttctctctgaagtaataagctcattggagatggggctaggagagtgataggactaggactaggactaggactgcctacactaggactgcagtccatgggaacagggagctaacaggagggtcccatagctagggtcatgtggcaggcagttcctgggaggaaggaggggtgacagccaggacaaggggcaagtgaggagctgctgccaagcttccctgccctctgggaccaggcaggccctggcctgcggacaccagcgtctgccactcatgcctgagtgtcaactgtcgagtgtccccaccccttcttggccttgccacataaagagctgtaggctttattttggaaacctacgttctttagaggcctgcttaattaagtttcccatttgcacctaaccctcgcatgcttgatgggcttcccttgctggagctatttttgcatcgttttctggaaggatgcctctttccccgcaggcagcctctgaccgtgtgccagagagctccgcgtttgcatcttatttttctgagcacttgctatttttattttttttggtactcatttgacctggacttctgataaggcgtttaaaaatagcctttggacttcctgtgggtaattgggcttctcagaatctcccctctacttttaaatacctgctgatttgtgtcgcctgatcccggcatggagtctggctatgcgtttggaaggtctctcgaatttcccttccacctctcagggttgcattatctcattactgactgagcacctcgccctgcagcgagaagggccaggtaccttgcgggccttctggagacaccaccagaaactcccatttgcagtagcaaatctgtacgcacacctgtttttccaaagtgggaatccaggtgatgtcgaagggctccagagggaacgcagaccacctggctctaagcctcctttaatgggacgagggacagaagccggcaggcacacgtcccactcagggtcacatggctggttggccatggcagagctgcagcctggaggccttgtccacccttgaggccatgtcggggtgtttgggacggcagagactgcccaccctcctgcatccgctgctctcctgggcccctgggctgctccaggccagcagccctggattggtgtagctcccctggccccaaggcctggcgttgggctgtggcttgcaggcctggctcggtcctaccactggtccttctatcatttaatcccgtggcgggcagcctcctgctgtggcatggcttccacagcccttcctccatcctgggcagccctgcaagggaggacacaggtgactcccttccagtctgtttctagagtgtctgggaccagctacttagcacctgtgctgagaggtccgtgggtttgtcgtcctgcaagagtggccctacatcatgtggctggatgtggagttggccttgaaactccgagtgctgctgcgctgtggttgcggctgtacctggcctggctggctgaggtctggttgcagtgaggggctggctctgtgaatcctgagctggtgtgtgcctcctcccggaggagggagctgcaccacatgccccgtggccttctgggcctacttgtggccaaatgagatcaggcgccaatagcatacggtctgactgctgactctttggggcacaactcacagggagatcctgccaagagacagaggtgggcctagatggacttcctttgaggaccccggcacatcatagaggctggcactacttgctgagtagtgcgaaggcttcccctacacagtgcgcccctgtgctgggcactgggaacaggtgcttagtttgatttcccttagccctcaccatagccctgtgagtgggtgccactgttttcccttttctgcagatgagtacactgaggcacagagaggtggaagaactggcccaaggcaacacagctagtagaggcagaggttgggtttgaacctgtgcagatggctcctgagctcctgctgcagccctgcggcccaggaaggcggtagtcttgttgcccttcctgccaactcactgcagaatctcagggaccaggtcagggggctgccagggtaattcgttggtcgttagggatgctgggatgcacttggcctcattctgggagggctgctgttctgcctgacacaggaggggttaagaagggaagggaagggccagacccacttggacttcagtctttcctctgccacttgcaagctgtttgtcctcgggctggtggcttaatttctcttatcttgtttcttcatcagtaaatgggggtgaggctctccccaaccccagcaaatgagaccctatttgtgaaggctactcaggagtcagatgcccatattcccacagccacccttgatgcaggtggccggggaggggtgggaggcccttttagggggacctgtgcttggggtttaatgctctgcagttgctgttttgagattcttggatatttacctttgcatttgtgttttgtgagatgtgttgggacagtaagcctgccagggcccagtagggccgggtgtgtgccttgctggagtagaagggtggccctggcccctatcaggctctgcactggccctgcctgaggaagcctggcatgaaatagcaaattaaaaaaatgctatggtgggttggggaggaactccaggagaaaggaaaaagccttacttttgctttttgcacagaagactgcacttgccttttgcatcaaatcccacagagtatgtagctggccccttgggcagccttggttatttggcatctgggtgaggcccaggaggtcagaggggttgaggtttttcacagagttgacctgtagttaagtaagcggcaggtttccagcagagttgtggctaagcccagtccccatgcagtgtgtcagttgggggtgctcgggagtgtggagcctgctgtgacatttgaagtctctcagtaccctaagcagaacacttagaagtcctgcccagtgcagggatggccacagcagggaccttctggaaccctcaagacatggcctgcataggttgtaaatcgaagcaaaccagccagccagcctgtgatctaagccctgtgagatcacagctgcagtgtcatctctaaatgacaggaatttatgaccctgaggaataaattatcaacagtgcaagacaggatcacttcaaacatccttgtgacaacttaaacaaaactcagtgagcaaggggtgtgtgcgagaggtagaggggcacagtgggctacctcttgggtaccctgcccagcacagattggaggatgatagctgtctgagtttctcaggctgctataacaaaataccacacactgtgtggcttaaacagcagacatcgatttctgtgagatgtttgtttctcatagtcctggaggtgggaagttcaaggtcaagcttccagcaggtctcattcccagtgagggctgtctccctggtttgtagacagccagtgtcttgctcctcacatggtggagacagagaacatttttcgtgtctcttaaaaggggactaatcccattcgtgaaggttccaccctcatgacctaatcaccttcccaaaggcctcacctcctgataccaaacctaggaagtacagcctttgacatacctaggctacgtggcacagcctgtgttccccggctgcagacctgtgcaggatgtgactatactgaacaccgtaggcagttgagacatagtggcaaatgtttgcgtagctaaatgcagaaaaggtacagtaaaaatacagtcttatgggaccccatggtatatgcagtcatcatggactgcaggtcttcacgtggtgtgtgactgtatttacatggtggccttaagcaccgtcttgagtttttctacacagttccacttaaaaaatggtcttgggggtccaggcatggtggttcatgcctgtaatcccagcactttgggaggctgaggcgggtggatcacaaggtcaggagatcgagaccatcctggctaacacggtgaaaccctgtctgtacgaaaaatacaaaaaattagccaggcgtggtggcgggtgcctgtagtcccagctacgggaggtgcttgcagtgagccgagatcatgccactgcactccagcctgggtgacagagtgagactccatctcaaaaagtaaaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggatggaatggaatgggatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaatggaaataacaaaattgtcttggggattagggcttagatgtagaaagcttaagtgtacacaaccttcagtctatagcacccgctgtacagcacgtgtccccagggacgtttgcagtgtctggggacagttttggttgtcacagctaaggtggggtgggtgctgctgagcatgctgtgatgcatgggacagccccccacagagaaatgtcaccagtggccagggtaagaaaccagcattttccttccaagccctagtgatgtggaggaaatgttacggacatgctccacatgctcctaaggtgactttgttggtatggaatatttctagtttacaagagaacagaataagaaactccagaacaccccatctgcagagtcgccagaggggccctatcctgcacctgtagttggggctttcagcaaggtgttctcagtgggcgtctgtttgctcagaggccttcccagaccctgccgcagaactcactagcagcctcctttccataggctccttcgtggggttgcctgtggttttctgtcatctgccttgtctttctctctttccctccatctctgatggcttctgtgtcctgtgtggtccctgggtatggctgtgaccttcatttcctttgtagtcccctgtgtcctgctcagtcggcgggtccaagcctccgactctgccctgtgtgcagagcctccaggctcccggcctccagccttgctcttctaggcaccgccgaccttttccacctggagatgccacagcctcttaaagtgagcttgtcccagcagcctgccccacccctacctggccaagctggaggcctcttttctcctggtgtccctgcactccggttggttcacctgctcacaggctctatttcttgctgcccctcctcacccctcatgcccactccatgaccaggtcctttagggccggctgagcacagaagaaaaacacagggccctgagttcacaggacaagagaaaagcttttcccctaagtgcggcctctcagcctgtcatggggtttcctatgtgctgtttcatgtcactcctccttgggccctgggtgctgttgggatagtgcagacctcgcagtggcccggggcccacccacactggcacccgggctgctgctggggacaaaggggcagcagcagcagctaagtggctgtggggacctgggtgggaccctgtgagctggagctccaggctgaagcagccgtgctcagggactctcagttctctcccctgtccctcagcacagaccttattttatatcaggtacggctctggcttcacacgtcttccttccggcggcctctgcatggctgcaagatgcacggtcctgaaatgatgctttagttttgcctcttctgcacttaaaaactcattttgcaaagtgaaaattttgctggccttgtatttgaagcctttcacagacagaccccagccccactctcccacaggcctccctgatctgtgacctagaacccacaggtacatggcctgggctttgggccttggccccttgcctgtgtgcaggctgtttcccggatctctctgtctccaggcacacatccaggtatctcagccgccacaggccagcagtcccacctctctctctcttatctctctctccccctggctaccccaggccacccttgctgtctcctgctagggtctcccctccctggtttggaagttgctctcctcctctttcagttttgaggtctctgaaagtgtgatctgggaccatgccgggcctctcacagcatggccttcgtttgggacgtttgtgtcaggaggcaagtgtctgcccacttctccagcccgtcagcagcatgggaaacgctgcgccttgcatggagagccacgtacagcccaggggcacagccaagcggtgaaaggagcattggtaggaaatgagctttgggaagtgggtataaatgctgctcagctgatctcttgggttatttaaatggggcatagtgccctccctccagggagaattatgtcctgtgttgctaagcctcctaccaatgagtctgacacatctgaaatcaatacaaggacccgtggcatcataaaaaaactggtggagaagcaaatgttttaattaaagtaacctgtaatatgtccaaaggaaacgggacacaggcacagaacctaggccacattgtatttgccttggagcctggctgggtctcgtgacagcacagctggcaggaggcacacagcctcccctcgaggcgatctcggccactttctcatcttgacagatcagcatatggacgcacttacagcttgtagatgaacacggggaagaaaacaacccttctcttccctcccttgtttcccaagccacctgtggactgcagagtgaggatgcggcccccaccttgcctccagtgctgcctcccaggtccatctcggcagcgtctggaccccctcggaggggagcgatggataatgaaactccctaggagtgtgtctcggctgctttgggctttccactctctgtttgagattttgtgaagggacacctaattgcccgaacttaattgtactttttagtacaattactaaatgtagtacaattacaattacacagtactttttctctttgtccctggggcgcgttcttgttcctcacatgtctgggtagctggtgggtggtcagcatggctgctttctccttcccctcccagcagtcagcagtgattattctttaaaaattgagaattcctttttcagagcatagagggtgaggcgtcagcccggccccaggaacctgggtcctgggaaaacagccagcacacagccttgggtgagcaccttctctccctgagcctcagtttccccatctggaaacgccacggccttcccgtggggctgtcgacagcccttcccatactatggagctcttaggatcatacacacatttaagcaaagggggtcgagagccccattcccgggaaagggcccaactttaagtgttgcagaatttatggactgaacaactgcttggctgattagcacagttttgtcccgatagtaatgttttagagtgtaggtgtcatggaaggaatgcaaacacaatgggagctggtcttgtgcctgaggataacacttgtgcctaacaaggtaacacttgggcctgaggatactggcctggccatggtcctacagtgattggaggggaagaggctccaaaggctacagaagctccgtcgagcctggaacactggtggccctgcacggtgccctgggcctgtccgtgtcctcagcagtcaaggagcactgtccactcattgagtgacatcctcattgaggatgccttgcccgcaagaaggaccctgcagagagccaggagcctcttcagagagccccagggcagcatcaggatgaggcaggctgtgtggctgtaattaagaggctacaggtggctctctcaggtggacgcagcagacagtggcgcagatgcggcggagcttgctagtccttatgctgccctgttgtgagacggatggccttgggagggtgtttccgcgtccctacgagcgcatcacctgtggtcaggcgatcactgtatccctggccatgacatattctttaagtcgcttcttagttcctaagtcccaccgctccccattgcctcctgaatgcagttgctctgatcccagggcatgcatttggagccctctgggactgctccatgtggttcgtccagctctctggaacactgttctccactttccctttgcacgacaagcatcgtggccctgtctctgtgcaccccatgtgagtgtcctggccctgtgtctctgtgcaccctgcacttccaccccctgggcctggagccccatcttctctccatgggtatgctctgcccagcccacagaacccacatacctttcacaccctcggtccatccattcctgccctttgtctcatgcacgcctcgactctgaagcgtttgctctcttgtgtgggtgcctcgctacctacccctgggcccttcttgttccctgtgcggcctggcagcccttgatggcagggctgatgtgtgtgctgttgtggccccaaggcctcccagcagagcatctgcacggtgctccagtgtgaagcatttgtgggcttgaaggggctctgagtgtgaaaacccgagtagtttatatctttgagacgtcaggaggccattcgaaaaatgcctggatttgcacctcctgcccactggctgtcatgaacagtctcagacaaggcgaagagggtaaggagaatccagtgaaggtctgtctcttctccatttagattcagccattaactctgccacatctgctctttccttttatctgtctgtatgtctgtctgtctgtcttgggtgaaccatgaaacttactttgcttatgccctgttgcttcattcctagataatttagcagacacctctgcagaataagggcactcttctgtgatcctgttatctcacctaagagagttagcaggaatctccttatcttatcttttaaatcattatcaataccagttcacattcaggttttcctgattgtcccttaaaaatctgctgtagtttttgttaaaactgggttcacttgtggcttttgttatgcccctccaatctcccttattctagactagtttctcaacattgtacatatatttgtgtgcaatgtacaatgtacacataaatgggtgtgttcagcagcgtccctggcctccatcctccaggtgccggcagcgccacctactccaccaccaggtgtgacaacccacacattgccagggacctgctggcaggcaggatgccccattggagaactgttctagcagtctcttactttgcttttgaaggtattgaccctttgaagagaccaagccaattattttgtcaaatgtcctgcattctagatttattgggtcatttcttgatggtgccattgaacttgtttcttgattccctgtattttctgtagcgtggaagtgggggctaaactaaaggcttttttgtgttccagggaaataattttagaagtctgccttttaaagtagagcaactgggtgggcatggtggctcatgcctgtaatccttgtgctccaggaggctgaggcaggaggatcacttgaagccaggaggttgagaccggcctggtcaacatagtgataccctgtctctacaaaactaaaaatattaactgggcatagaagtacatgcctgtagtctcagctacttgggaggccgaggtaggaggatgccttgaatacaagagattgaggctacaatgagccatgtttatgccgctgcactccagcctgggcagcagagtgaaactccgtctctaaaaataaataaataataaaataagataaaaaaaattagagcaacttatgtgacttttttttttttttttttaaactgagtcttgccatgtcgtccaggctggagtgcagtggctcaatctcagctcaagagattctcctgccgcagccttctgagtagctgggactacaggcatgcatcaccatgcctagataattttttgtttttgttttttgtatttttagtagagacagggtttcaccatgttggccaggctggtcttgaactcctgacctcaagtgatccacctgcatccacctcccaaagtgctgggattacaggtgaaccactgtgccccgcccaacttatgtgactctttatgctcacacagaaactacattctaggggtgcagagggtatattcatcagatgggagaaggccacggtgagaatcacatggctcagtctgttggtgtcagggtctgcaccgtatctgccctagatctctgggcagaggtgttgtttcggggcagtgcactttgctcactggcaggaaggcagccccgctctgtgcagccttccccagcagcctccctgaagcagcggggggatcagagacagggaagcacactgtgtgtgtaaaatactcttgagcctaaagttggagttttctcctttccgcttcctgttttttcatagaaaccaactgaagggttatgaattatttgttgacttaaaaaagtagatgtgtgtttttctgagctctttgtaacattgagatttaccatgtttactccaaaagtgtttcaaggccaagtagtagttggagactaacctggtgaactgtcacttgtaccctgagatgcctttccagcctccgcggtgggcattgtatgacctgcacgtgaatggatgggtgacccaagccacccctctctccctggaggttttgcttggtgtagaatgttattctggggacacagcactatatttttaactatggtcgagattagaggaggctgggccgggcacggtggctcacgcctgtaatcccagcactttgggaggctgaagtgggcagatcatgaggtcaggagattgagaccatcctggctaacatggtgaaaccctgtctctactaaaaaataccaaaaatttgccgggcttggtggagggcacctgtagtcccagctactcaggaggctgaggcaggagagtggcgtgaacctgggaggcagagcatgcagttaaccaacatcgtgccaccgcactccagcctgggcgacagagtgagactccgtctcaaaaaaaaaaaaaaaaaaaaaaaaagaattagaggaggctgagtgtggtggctcacacctataatcccagcagtttgggaggtcaaggagggaggatagcttgaggctggagttcaagaccagcctgggaaacataagtaagaccctgtctctacaaaaaaaaaattttttttaaattagctgggcatattagtgtatgcttataattccagctactcaggagactgaggtcaaagaattgcttaagcccaggagttcaaggttacagtgagctatgattgtgccactgcactccagcctgggtgacaagagagagacactattagttacttaactctggcatttgctatttctgcactaattgtcaaagttgactgagcattctcagtgccccttctgcccagtcatgggccataagcttgtgtttgggatagcatgtctctgtgtcatgtgtggcttgttatggttgcctggaatgaacttcaacacacctctgtttggctgagcgctgcatttgcaggaggtgagaaccactcagggcctgaggcagaacctgaccatgctcatttggaggagagggcctggggagcttagtgcgctcaagaagaaggcagatagggctgtgtgtgctgtagaggatgataaactgggggtgagggtgcaatgacgacacagtgccacattttagaactatgctctcatcttgtgcaaacaggtctgtttacagcagttcatttttatgagttacaattattatttctggataattttggtgtatggtaatcattagagtaagctgtgtgtctgattaaagaatttgtctctaatttatgccaatttaaagatgtcttctgtgttctctttgtctctgggggagggaagcaggttgctatggagacaacataagaaaaagtgacaggcaagaaggcttggcagtttcgattttgaaaatatttgtgatgtaggtaattatatatgtaataatgttatgcagcagaaccatctgcctttggagagatgcatgtcatggaatttcatggtaaaacagtgtttctcttaggaacaaaatgttatttgtgtgctattaagatattgaaattgtggaaaataaagatgcaatggagccctaagattgtttccaggggtgcagttgctgtatgatgtaaggtgccacctatagaatttggaaagctattttcacatggaaacaaaacatttgtataggaagacttacctgagactgaattattttatgttgtaaattgctaaaatcaactgtattcaggtttataactgattttgatcagtttaaatggcacaattttcttttttaaaaaaaattaaactatacctcatattgtttggggaccaatttaacaaattggcctatggcagtttccctgtatcatcattttcccagggatcttggcttagttttgctctaatctggaattccttcttttactcttacacagttgagcattccccctcccccatttttaaattctggtgagatttaaaagaagaagaaactttagcatgcgatttgttaaattcaacaattctgcaaatatttacggaatgcctgtgctgggcacagtgctgggccctcagacacacatgctgctgcccccatgggctcagagtctgagcttaagctctgctgagacagcatgcaactgccctgtggcacctacctggctctgctggcagagcaaagctgaggttttagttcacatcttcatgtgatggattcgatatggttgcagaattgcagatccacagacactcctgccacctgcaggtggggcatatcccttcccttaaacctgggctccatggctgctttgaccaatcaaatacagcagaagtttcccatgctcggtcttcagggatgggcagcttatgcttcctgtatcttggaacacttgctgtctaggagcccagccatcatgtgaggaagcccaagaagccctgtggagaagggcaaaggctcccagtaacagttacagctaagctccatgtgattgagctttcttggaagtggagccaccagcaccaaccgacccacctgcagcagagctgttcccaccaagctctgttcaagttgcatatttgtaagcagtcatttgactttactgttttaatacactaagtttggagcaagtttgttatgtaacaatagataaccagaatactgttttttctgtaatcctgtactgttgctgtgggaatatgccagtgtctaatttccttgtcagaggaagtgaggtcaagggaatcttgccctagaaatacatgtgttgagcagatgtctcaagcatgagatacttaagcatctccaggaaaaggcaaattcaggttcattctctcttactggcctgctagagaagatccttaaagagggccagtgtgggcatctggagaaggactgtaggatccaggccatcagacagaggtgtctttggccatgggcaggtggggttcatgttcacagaggcccgacatcaacacggacatatggacccagagtggcagtgctggccccagcacctgtagacccacaccaactttccgtggcagccagtaccttaaacaaaacccacaaatgttgcccaactttttctactgttgccactgggaagtgggtccaaaccctctgtgctgtggtctgcctgggcatcatagttgtgtacctgaggctggtggtctcatatgccgtggcatcaacacctgtttatgggctgtaggaaaactgagaggtcatcacattcagagattcccttgtgccaggtcctgcgcgggtgattttggtgaccatgactgagttttcttggctccagtggtgtgctggcaaacgtttaacagttggcttcctaggaagatgccctgagtgatagtgtttgtccatttccagggtgtaaacactcccacctggccgattccaagctgcttatgtgatgccatgggttgggagagctgcaaacactcctgagctgggagagcaggcctgggtacagcaagggaggcgagaactgtgcagtgtgttatctgaggaaagttcctagctctcatggggaagattttccttccttttgagtttcctatccactccctgctgtgtaggtggggaggaaagggagaaacgctgtgaatcagtcgactgctcctctggcaagcaggacccatttctaaagcatgagtcactacaaaatgtagctttttagatggaaaaatctatttacaaaccctaggtgagagtaaatggtttgttcacctcctgtgcttacttggtagaatgacaaattggacactccagtattccaagatttattattgtgacaaaacatatattacataaattttaccatttttaagtctacagttcagtggcattaagtacgtcccccctgttttgtaaccactgccactatttctgagcaacacctttccaaactgtgtccccattaaacacgaactcctccacgctcagcccccccagtaacctctgttatactttctgtctctgtgaatgactattctagggaccgcagagtcaaacagtatttgtccttttgtgtctggcttatttcatttagcacagggtcctcaggattcatcgacatagccgcatgcgtcacaatctccttcctccttcatgctgaataatattccattgtatggctagaccacattttgtgtattcattcatctgttcacagacatttgggtgtttctgccttttggctgttgggaataatgtcactatgcgtgtaggtgtacaaacatctgtttgagtccttgctttgagtttttttgagtatagacctaaaaatgatatttcaagatttttaatgtcactgatctgtgaagtccaaagcgggaaagcctggtcttttccgtgctccctcgttttgtctgtaggcattgagcacagtgaggctacatgttgttttcagagttgcccagcagcctggagactgctggagctgcatcccagggagacagtggctggagtaacaccaaccagacaatgagatgggacatctggggctttcaagagctcagggcaaatggcctaagcaggtggctctgcaggtgtggattgtgtccagctcagggaagtgcctgggcctggtggggcctggagtaaggggagaggtggggtctgatgagcttactccaggtgggaggcccaggaaggaggttgggttttcctcccggggttctctctgggtgtaggcagggaggaaagggagaaatgctgtgaattagtcgactgcttctctggcaagcacgacctatttctaaagcatgagtcactacaaaatgtagctttttaaatttaaaaatctatttacaacctaggtgagaaatctttattttaattgtgaaggaaaacacaaccccacttgacacgtggtggaattgctgctgtcctttcctgtcagagcctcccagtgggctgggtttggggatggatggggtgcacacccgctctgctcagttccttcttcctcctggcacacgggttgatgacagctcttcagttgagtctgttctgctctgtctggtagggagcacacctttttggttaatatgcccatttatgtgtgtctatggggcctctggagaaaacgttacttgcagaattaagcacaattaaaggagaagtgagccctgctgacctgaaagcaggtgggggctgctccttggctgggataaaaggcaaggaggcaaccctgataaatggcagctggctaggtggtgaggggatgtcctgccatttgcagcaaggcattggttacaagcctggattttgtttaacatctttattaataatgctggaggcaacagtaaacagcaatttaatgaaattcacagaagatgctaaatcaggaggtgttataaacagcagggaagccctggcgaggtaagaagcatggagcggaaggagtaggggccgtgtctgagaagaatgcagatgggcgcaactgcggtggagggggagcccagtcttccaggtatccagtaggagcggatcagcaagctccggggctgtcacagagcaggcagctacgtgctggagagcacagcagtggggagcattagacagacagatgcacatgagcccttcggcccttcctgcatttctttcttttttttttttttgagatggagtctcgctctgtcacccagggtggagtgcaatggtgcaatcttggctcacttcaacctccgcctgctgggtttaagcagttctcctgcctcagcctccctgagtagctgggattacaggcattcaccatgcccagctattttttgtatttttaggagagacagggtttccccatgttggccaggctggtttcaaactctggaccacaggtgatccgccctcctcggcctcccaaagtgctgggattacaggtgtgagacaccgcacccagccccttcccacatttctgttacctctttctagaaacctgaatgtgaatgccactgaattcaataaatgactgattgagcacctgcattggtgtaactggtgggctttgcggaattccagggagatagcgaaacttggaatgtaagctggtgaatgggtggttggtgcggcttgccgggcaatggtccgaatcgagcctctgggtggctgtggttttgtttggcttctggatgacttgtcagggtaccagccactggtgtctgatctgggattttcttcctcctcttcttgactcctcacttccctccaactccatgaaatgaggctgcccagaaaaggctgaaggaagtcagttggctcgctatggaggaggggcagttttcaattagagtctgaccatgttgtcgggaaagtaggggactgctttggctggttatacgtgactataaatcccaacttggacagtatttcatttagaatcctgacaaggaaaaacaatacaaaagtctcaaaatgaatttgttagcaaccatcctgactgcattgtgaggctttccgacagctccagggaggttggcttgaggtagctttgcccagctggctggagaaatgagatcaagtggagtggcttgaggagaagtcggctgacccacacatttgacagatcttttgggttcattgatctttgtcaatgtttcttctccagatagcaacctcccttttcttgtgttaaatggactcacctgattgtaatcacagaactaattgttgtataataaagacccattctctctttgcccgtggcccaaagcagccttctcccccacccgtcagttccctctgcccctggtatttccctgctggaggagttagacctcctggtgagctggtgtggggtaggtgccataccaggctgggcactggaagaacaagggtggatcagacacagtcttggctttatggaacttctgttgggtgggggagaaagatgattggaatatagtggatgatgaaaagacagatgctgcccacacatcccagggaagccctgtgctgagcggtgtgcaggtgtcggcagcagggtaggagtgcactctgagcaggtggaggatgcagtcctgggaaggctcggaggaatctgaaagcacagtcaagcagttgcatcactttgggtgctctgggctgcaagtcatgaacacccagtttttaaactgggtttaaaccacatgggcgcggttgcttattctcttccttggcaagaactctggaagtaggtggtcccagggctgcttctgagctcagtgatgtactcaggacatggctcttcctccctctttgcccttccacaccctggtgtgtccatagcataaggctatgtgtacgccaaacgcagcccgggcatcttgtcctccagtgataactgctgggtgacaggagggacggaccagggctcctcaaacctccctcattttattagggaagaaagtgttcccagaagcatccaggacacttccccttatatctcactggtgaggacgtggccccaggatctgcagggagcctggagaagggcatatctgccatctgaagcctctatcacctaacagggggctgggctcttaaagcaaggaagatgggggcattgggtggacaccagctgtgtccaacacagcaggcacctttgagccatgtcagggcagcaaactgtgtgtctacacaggcatactaaggtcaggtcaagatggcttcatctgtcacgtgtcagagcctggcctttatcctttaccttgagtggggaacgtggggatggttttaaataggaacgtgacgtggtctcactgtggtgtggtgtgatagggtgtggtgtggtgtggtggatgggctggaagggcagggttacagcccgtgggtcgttctgaggtcactgaagtaacccaagcccatgaggcaaagcctcccgggacactggtgtcagagtgtggaggaagctgactcagtgactgccctcagaggcctggagcagtccctgcaaaagacctgtggattgggtggacgtggcgggcaggggagggaggagctctgagaccagccctgcagttctggttggaggaaatggagggcaggcagtggtcactggacggcgaggaggaaggggtgtttctgccaattgtcttgggtgtgccgggtgcccccatgctgcgtctaggtaggggcctcagcaggctgttggaggtgaggctaagacgcagactggaagtgactggaaataaagctgtcagcatgtggtttatgggtaaaaccacaagagataagatcacccaaagggagtggccccaaaagctggggcagaagggcttgccttattctcctgggagcattgctaccctggcagaggaggggccttggggctgtgggggcagcaggaggccggggccacgtgtgctgtgtagagagttcttgtgtaacaaacctgcacactgtgtacatgtaccctagaacttaaagtattaaaaaaaaagagtcatagaaaagagaaaaaaaaaaaaaggagtggagcccaagccagccaggccctggcgtagaagacctgtgagacaaggactaagaaatttcattgacatgaaacaaaagggggatgattgaaagacagccaaacaggaatcctttttgaggaggacatctgaacagccctggaagaacgtctctgcctgacactcttgctggcatctgtgggctctctctgtcccgtggacaggacaatcagaagatgggctccactccagctgcaactctggtgacatttagctgtgtggccttgagcctgtggcttcacccctctggacttgcgtcctcacccctaaaggggagcaagatctatgtatattggagactgagttccaagggctgctgggggtgacgcggacagcagtgttttgggagatctgagacttggagggtggtaggcactgacaccacagcccaggagctctgcaccagctgtagtgagctgaggagagaaggggcacgtcgctgagctcacacatcttggtggaggcagagtaagatctcaaataatctgagaaaacagcttttgtacttctaaccagtaaagctgtccatggaaaaaatgagcagcgttaaaccttcagtgggacgactaacctccatacacatcacaattgaccgtgttaagcatctacgtgtctttctgtgtttctctctctctgagcattgctcaattatggaataagaagtctgtaacctcccctcatggtccctgcccccttactaatgtcacgggcagaggaaactggagggtaggggagaaggccactttgggtcatgggtaaagagagaataagtcttcattatacaattgttttgtgattaaaatcaggagagttgatttaacaccagagaagggagggtgcattctggagaaggtacgttgataaagatcagtgaactcagatgctttgtaaaatactcaagctagctgacccctcctcaagccactttacaccatcagaacaggggtgggaggtagccgggccctgatttcagcagtgtgtactcggagtgcactcctgcttctatgtgggttcctctcgggagagcccctgtctgatgtagttttttgcctgtgatgagtgcctctctgggtagagttcttcctcggtgactctggatgccaggaagggtgctgggctctcacctacgattttactgagaagctgctgcttctggaatcctacacccagaccgtgtgactcaccctgtgaactgccactgctaggacatctaatgggggacatcgctgcacagttgtacatctaaggatggagggatgagctgggatttgccctgtgttcaggttgcacgagtttgttccttttctttcttctgacatggaagcagatgttaggagtcccgaggaaccggcatacagagtggggtccacacagagctgcgaatgtggaactgggcttctaccgtgccagcggccacgtgagctgggtgcccatgtcccatggcttgttaacttccaagtctagaattttcccatggccatgactgcacccattcatgggggagctggggcaggaacaggtaagacagccaagcagtcagtctgaagaacggagcctgtcagctgctggaggaggaacccgggggacatcgtgaggtctggttcccagctcagcatcggtggggagtgagtcgggagagagagtgaactgggatccactaggcacctgcccatcattgcatctactgttgcctccctgcctgcttccaggtcctaactactttctctctggccagctctagccctgacttaaagggaaggggattaaaggaaatagcattctcagcttagtgatcccaccttgaggacagtgtttccacacctcacagcatatcatttatttagctccaaaaccaccctctgtgttaaaacggtgagatccactttgcagaggaggaacctgagtccaggggagttggtcacttgagggcggtgcagggcttatccatggagaagtggcagtgcacgcccacctggccgcaaagcttaagtgccttgcttctgtgatacagaaagtcagcagagaacacacagcccgaagcctgaggtggggcagagcgtttcctgaaggtgagatggccagccatgctctgtaggctgatgggtgcccaccctgcatgctcactggaacctcctgccctctctagccagtgcccaaggcagggtgaaactgtggggtcacatgcttgtctgatcatttgctaggacctgatttaaattggcatacaaatatatttttttaaattgtggcaaaatatacataacataaaaatttaccattttagccatttgtaagcaaacagttcagtggcattaagcacattctcattgttgtgaaaccatcaccaccatccatcttcagaactcttttcgtcttcccaaaccgaaattctgtccccataaacacttaactccccattcctccaccctccaggccctggcacccactcttctactttgtttctttgaatttggctggatttaagtggaattacacagtatttatccttttgtgttggcttatttcactcagcacagtgtcctctaggctcattcatgctgcagtgtgtgtcagatctccttcctctttaaggctaaatcctattccatcgtacggtcatccacatcttgtttattcattcgtctgctcatggacacttggggttgttttctgtagacaatattctgggagcaatcactcttttaataaaattctgtcttccattgaaccttttgggtatcttttattatggtttttcaaatacagagtccttggagaaccttggttgttctctttgtagatacgtatttggaactgcacttaccatatcgtgaatgaggctacaggtcaaattcccatctgaacatcaccctgatcttgaccttagtctgctcaccagatggtttgtctcagctccaggtttatggccacgattggtaaatagactcactccacatcttagtaataggaagaagtcatcccgggcttccccagacttcaagtatctttagaatgttgagcttccggcagatttttctctaccaggacctaccacatcctgcatgtgttataaacagaatcagtccaccagaatgagaacaacctgccagtgatgggaatgagatgaggaagctctctcaccggctagaagaccagatgtccgaagacctttttgggggagggtggggtgttgcctaacaccaaataactatggccactcaactaatagatcattcttctcccgcctgcatctgattgctggcctggctgtggtgctgggcaggctggacaccaccagcttcccccaggcaggggagcccccatctcccccatacaggggatctctgttgtggcctggcacaagggagctggcccggctgtgggtggccttgcaagacagctcagccaggacctttccctcgagggctctgccttgctcctgccggttgccttcccacaggtgtgcggactcgagtttgcttggatggaaccaggtgccacaagtgaagcaagtggcagacagctgcggggaggggtgctgtgttgtggtaagagtagtcaatagaggtttttggaaactgagtagagacagaaaaccattgtcctctccttttctgttctattaaaaaaaaaaaatcctgcctggcctcaccagtttctgaggcacgtgacaaaatttagttttcatcagggtccttcatgtggcatggcacaaaaaaagacatttcagtatttatttgaaactttcttggctctcttgcccccgtttttgtggcttagaggaaggtgtggatttcttctacttcaccagaattgtcctttcaattcaaaatatgggcttctgagttgctggatgaaatgttctagaaacagtctttgagtgaaaatgttatgcttaacaaaacgagcttcagtttccacttcctttctgctatacaaacctatgtggtgctgcttattaggcagaaatagaagagcagatggaagggtgtgtggtacggatgccttctgaccacaaaatcaaacaatagaccttttcatctctcggtcaaaatacagcctcatcacctctcctctcagccaaaaagcaacacagaaatgcacagtttgggcataggagcaggccctgccggccagcaggagtgagggagggtggtgttttcttgccctttcatcatggctggactttggcactttgttctctaagtgaaaacaaaaatagccactgacttgggctctgactatatttgctgtttctttaatgcttctcttccttgctaaaaatacattagaggtgattaatcaaacacacacacaaacacacaaacccacaatcaatgcaattaaaaatatataggtggagaaagacaagaaccaggtgagagccctgccttccctgcacggaccaggcttgtagaggggtgtgtctctcttcctcactgtttctgttctgggattatgcctgttatgggcactgacctctctttcttggctgcagtgccatttgggggctcagtcctcatttagctgaccttaatttggatggttcccaactttccatcaactggcattgcacatgactggctttgtggagttccacctctctcgctcacaccccattcacaatgaggatagaggggctaccgcctggagcatgggaggatcctgaacttgggagcttccatgagagaatgtatttgagttgttctcagactaccgtttttgctcagcacttttttggggggctcagtattatttccaaaacattttgtgtaattacataaggtttctacttctttaatttgccaagtaaaatgttaaaaaattttcaccatcacttaataaaacaaggaacattttagtattgcaaaaggaggaagaacagccatttttatccgacatagaattggaagctctagacagagaaattagggaaggaaaataaattattggcttccaaattggaaaaaaaaaagtaaaattatctctgtttgcagatgatacgatcttatgcatagaaaactctaaggagttctcagagttttcagagctagtaaatgaattcggcaaagttgcaaaatataaaattaaagctcacagttcagttgtatttctatagacttgaacaatccgaaaaggaaataaaaaattcaatttgcaatctcatcaaaaagaataaaatacttgggaataaacttgaccaaagaggtgaaagattggcacactgaaaactacaacatgtttttgatacaaataagtggaaatgcatctcttgttcatggattggaagacttaatattgttgagatgacactactactcaaagtgatctacagattcagggcaatctctatcaaaaccccaatggcgttttttagagaaatagtaaaaaagcactctaaaatttatatggaatctcaagggaccccaaataaccaaaacaatcttgaaaaggaggagcaaagttggaagactcacacttcctgatttcaaaatgtactataagcaatagtaatcaaaactatgttattagcataagggatagatatataaaccaatggaatacaacagagatcccagaaacaaactgtcacatgtatggtccattggtttttcaacaaagaagccaagatcagtcaatgaggaatgggcagcctttttaacaaatggtgctgggaaaactggatattcttatgcaaaacaatgaagtcagacctttatctaacatggtctagaaaattaactcaaaatgggttaaagatctcaacataagagctaaaattataaaactgttataagaatacacaggtaaaaaccttcatggcctggaattaggcaatgatttcttgagtgtgacaccaaaagcacaggcaatacaagaaaaaaatacataatttggatttcatcaaaacgcaaaagttttgtgcttcaaaggataccatcaagagagtgaaaagataacctaaagaatgggagaaaatatttgcaaatcattgtttagtaaataatgaatatctggaatatataaagaacttctataactcaataatttaaaaaacccaattcaaaaatgggtcaaggttttcagtaaacattttcccaaagatatacaaatggccagtaagcacatgaaaagatgcttcatgtcatttgttactagaggaatgcaaatcagaaccacagtgagaaaccattcccacctgttagaaggggcattttccaaaaagtagaagataataagggttaggatgtggagaaattgttatgctagtgggcatataaaatggtacagctgctgtgcaaaacagtgtgaaaggagtttgaacatgcaattactgtataatttgaacacagaattaactatataatccagcagttctattcctaggcttatacccaaatgaattgtgaaccgggactgaaacagatatgtgtacaccaatgttcataattgcattattcataatagccaaatgtccactgacagatgacagggtaaacaaaatgtggtatgtatacacagttgaggaatattcagccttagaaagaaatgaagttatgacacgtgctgcatggatgaactttgaagtcattatgctgagtgaaataagtgaggtgcatacaagtcatgcacagaggaaccatggacctggaataaaaagtcagtcttccacatcctagtcagcctctcttaatttttttcttttcaataacagccattctaactgggtggaggtgatattttattgtggttttaatgtgcatcttcctggctgggccaggtgactcacggctgtaatcccagcattttgggaggctgagacaggcagatcacttgagctcaggcgtttgagaccagcctggccaatatggcaaaaccctgtctctactaaaaatacaaaaattagccaagtgtggtggtgcacgcctgtaatcccagctactcgggaggctgaggcagagaattgcttgaacctgggaggcagaggctgcggtaagccgcgatcgcgccagtgcactccagcctgggtgacagggtgagactccatctcaaaaaaaaaaaaaaaaaaaaagtgtgcatcttcctgatggttagtaatgttgagcattttttcataaacctgttggccatttctgtgtcttttgagaaatgtctcttcctttccttccccaatttttaatgggattaaggacgtggagaaaagggaactcacatatactattggtgggaacataaataaggcagccactatggaaaccagtaggaaagtttctcagaaaacgaaaactagaactatcatatgatccaacaatcccactgctgggtatttatccaaaggaaaagaaatcagtgtatcaaagggatacctgcacccctgcatttattgcagcactagtcacaatagcaaagatgtgaatcagcccaagtgtccatcaactgatgaatggattaaaaaaaaaaaacacaggggatactattcagcctttcaaaagaatgaaatcatgtcatttgcagcaacatggatgaaactgcaggtggttatggtaaatgaaacaagccaggcacagaaaggcaaatattggacgatctcactcatatgtggaagctaaaaaaggtgctcgcatgaagacagagtagagtgccagatgccagtgtctggaaaggatgtgttggtggtagggaggtaaagaaaggttggttaagggtataaacatacagtcagaaggaatgaattctcgtgtttgatagtacagcagggtgattagttaacaacaatttattgtatattttacaatagctaaaagagatttgaatatgtcccaacacaaagaaatgataaagatttgaggtgatggatatgctagttaccctgatttgatcattacacattgtatgtatcaaaatattatatgtaccccataaatatgtacaattattatgtatcagtaaaagttcctccaaaaaaataaaaagagtccatccttcagcagagggagtgcattgttggaggggcaagggtgagaggccaggagagcaggccctgggcttagcctccagcatccacagcacgcgtgtgccctggactgggcctaggaagggtggtgccctggtggcctatgctggccctgtggagcctggccaggccttccctgtacctcctccctaaaaccctgggatggcgtgggctcctttcttctaccactgacatccagtgtttctgttaaattaggtggtctgcctaaggactttttggtttgctaaaagacaaaacaaaacacaggaaataaagcacattttccagttctcagccagcagcgcaggtcctctgtgaccacatggcatccccaaggtgtccgcgtgtatcccacatggggactcagccagctgtgagagggatggacctgcccctgcctggggctacggtccccatactctcccatcaacagggtctgtactcactgcacccttcagggtgaagagggcactgtccgcccctgtggccatcagatggtgtgatcccacctcttggcagaggctggcaccacgccctgatgcttctccatcccagacagggggaagcaggtggttggagagaggtgggaggatgaggttgccaccttctcctgaaaccagcatgggtgctgctgccacagatcatgaatgctttgtccccctttgctgccgtcccatgcagtcaagtgccctgataaccaggagttggctgttaccagatccagagccctcagaggctgcgtgagcaccagccacgtgagcagcctacctggtgtgtttcccagagccgacagagccaagaggggcgttctgaagcccgaagaagcaggagtggccactaggagctgccgtgtgctcgctgtgatggagttgccgaagtgctttgattcctcggttatttcaggcattgtccccctttgggagtgggcatggcctgcccatgtcagtcctaggtcagtggctggaaatgagcagaatggaagcgtaggaagggcttgaggggtgtgggcacatgcttcagctgcgggctccattcaagcatcggtggagggcagtagcaccatgcagacaactggagctccttagtgctccctgggtagccctgcacctctccatggctctcccctgaattctgccccccacgtgatgctgccccaacgtggagatccgggatgtgtcgttgtctttccttgcagagccgtggaggacagcctctgagccatccctgctagtctctgctcctggcacatgaaagtgttcaatacatgtttgtgcagaaagtgaaattaaaatctgtccacttggtagctggatgtggtggcacatgtctgttgtcccagctactccggaggctgaggtaggaggatcagatcacttgagcctggggggtgtgggttgcagtgagccatgattgtgccactgcactccagcctaggtgacagagtgagactccgtctcaaaaacaaattcaatcaataaaatctgtccacatggctcattaatggatagaatgttaagagctggaatagcttcagggtttacctagcctcgccccttgttttacacaaaaagaaactgaggcctggtctcccacttctgcccctgcttggcaggcctagagagtgtgtgtgcatgtgcaaatggagggggtgtgggcattgggagtttaaacttggcttgaatagctaatcagatctatcaaaattaggtttttaccaagcatagtaaaataagacttgtttggtattattagtgatgctaaaactatatgtcacatattggacaaataagcacattttcagatacgcatgtgggattttgattgcatgctgggtttagtccaagattaaatctgcattttgttctgatgtaaaagggacttgaagcagtttttgaggtcatgtgcatagcagcagtgatggaaatgtcctgtgtctgctctgttcagtacagtagcgaccagccacaggtgactactgagctcatgaatgtggccggcgtggctcaggaagtggcttttaaaatttcattttgccaggcgcagtggctcacacctgtaatcccggcactttggaaggccaaggcgggcagatcacttgaggtcaggagttcaagaccaacctagctaacatggtgaaaccccgtctctactaaaatacaaaaattagcccagcatggtggtgggcacctgtaatcccagctacttgggaggctgaggcattagaatcgcttgaaacctggagagggaggttgcagtgggctgagatcatgccactgcagtccagcctgggtgacagagcaagactctgtctcaaaaaaattttttttcatttaattctagtcaattaaaactgaaatttaaataattacctgtggctagtggctactctaatggacagctagagaactgcagcataaccttatctttttaaaaatcttattttaaaaagaattttgtgggtttgaaggaaagattgtctggaagaaggaagtgactgagacatagctttttgacacctggcctggagccttttcgtttagaccaaccaactaagctggatgacaccagcacagtcccttaaattccctggcctcagtttcctcttgtgtaaaatgaggttctatggcttctgctagttctgagattctatcttgccccattcttggcaactgggatatgaagagctctattttaataacgataataataaagaaggcttattaaacactggggatccggctgaatagtcctcaaaccattgtactcagctgggtggagagacctgcaagtaaccaagggaagtttcaaaatgtgggtttccgggctccgcttggacccatttcacagggacccgaaatctgcacgttaacaggtttcacaacgattctcacacaaacaactccctttaaagatacaggccaggccgactccccactggggactgggtgggctgacccacctggcccactcacactcaccatgtggagttttctcctgagagttaggccagggaatgatttttaatgtgggatgctccacgttcctctctgggacttcccatttgcaatgtcttaagtcactttcatgtttgaatttagaaaatcaaaagatgaccgtcttgtttcctgtaaatatcaggaacagagaggagagcaggtggtgtgtttgtcctagacttaaattttaagatttatttttataagttagtttcaagtttgctttctttcgttcttaaaattgagatagggtctcgctctgttgcccgggctgcactgcagaagtgcgatcccggctcactgtagccttgacctcctgggatgaagtgatcctcccctctcagcctcccgagtagctgggactatagtcgctttccaccatgccagctaaaagtttgctttcaaagagtccctattctaatctgttgttggagctctccacaatgaatcaccaaaataccattttaatattagagtagtattttgtcaggaaaaaataggcctgaccctgaacaacttatctgcatagctgtaatattgtcatttttgactcaggctaaatcacttgttaattttaggaggaaatgtcagaggaggttgtccccaaatagcagttattatctgtttcccaggtttatgaacccagctcacagctctgcttgtcaacatctgcagaaggaacttagagaaagactggctccttttacattttttttgttacaatagttaatgtaagagtagttatgtaaacagatcaataagctcattttgaacatgaccctgccaactgtttcaaagctaaagtcacattgactcaggaaggtcagctgtttcatctacagtgtctgtggcccatggaggaactggagccatgtgaggtctaatgacacacgtggcccatgtgcagtcctcatcgttaagtaagtaccctgctgacctcttaagacataaaccaaaaataaactgtagcaaccacttctttttaagtccctttaaagtttagatttttactgttcttagggtgactttgtggctcatcactcttagctttttctcattgcttcttgaatcgctcccctttcctgagtgtttcttggtctgccatcttgacttctcccggggccatgcatctgctccctttgtggctccgtttgctcctaagtctttgcaggatctccacgcagaaggcgtggtgctggatctttaggggacattcagatatagacatgctttgtgccattaaggaacttgtggcttagtaagaagaacagctggttacagaaatgaaccaggacccctacagctgcaggagagaaactaactggaatcagtcaaaacacagagagaagcaaagccgtgtggtggcccagataaccaagggtcctgaggtagatgcatccaccatggccgggttcatggctcagatgatgccatcaggacttggtctctttctagctctgggtcccaccaagcttttccatggtggcctagcagctccactgtcctcttcataggtgcaagagggctttaggggtctttgtcatgtttctggggtctttgctggaacatctgcagaactcacgagattcactccggctgagtgaactgatggcagtggcagtggttggctcagacttagggtgtgtgttttctcctgaaattgagaggatcccacccaggcctcaggggctgaaagttgggggaaggagctaagagaaaattggtgcctgtagctagaagaagctctgtgaatgtcaggcacacaaagctacacgtccatgccagaaagtcacaatactaagggacttctcaagtcctggttctcaggtccttaggggtcctggttcatttctgtaaccagctgttcttcttactaagccacaagttctcacagtcaagtaaaaaccaaatgcgactggagttatgaggatggtgacattgaagctatcagggactgcttcatgttgggtgctttgtgtgggctcccgggtctgcctgggccctgcccttcatccctgtctgcttctctgggagatccctggctcttgggattgtctgtgtgtgggagattcccctggatctggcctggccatgcccactggcttcatggggtacacggcagctcccctgcttctgtgctgtgctccctgcaggtcacaggatccacttctctgcaagtgccagaatcttgtgcagtcctttcgggtccaacgcaagttctttttctgggtaggtcaccccccagccaactggagtcaacacttcctttcccgaattcccgctcactctggcaatctcccttggcccttcggtcgctccgcctttcatcggtttgtctgcaactgcagttccctgtaggcttcatgatggtgaccgtcattcctgatgtttcccaaacaaacgtgcattggtgcttttctggctcaaggggcatgggatttacatttgctgtgggtaggaaagagtggggaatagttcagtgttttcctttatttgtaggaaagtgatgcccagacacaggtacgagtgtctggtttggtacttttactctctcttgacacatacaggcaatctctaatggctgtgttttcatgctgcaaatgatgtacttgcaacgtttggcaaacatggtgctacttgcttataatactgtcagaaattcaatcggcagccctcctagtccccaggaatgtgcttggtggcaggtgttagcagtgcgtgtctatcccccaaaggcttttattgtctcattaatgagcaggtgcaataaatgtgttgtagacagcatctctgttagtctgaagatgtttgggatgtgtgttctatttccacatgtcaccctgtagaggaaaaccaactgttttccttgatacccacaatgcacccagaacacttctgataccagatgtgtgtggggttttgccacaccaagcaattctccagttgtttgcagatgccaactgggtattcagttcagttctgaccccttccatgtggagctagtatggaccctgcaggttaagggctcaatctcatcaggctgccttcacttcagaggccagttgcaagaggtgtcttcaggttacctggaacttctgtgtggcgtggctgcaaatctggtttattatattagtggagggcatgataaaagatacaggcaagcagccagatggagaggtacatagggcgaggtctggaagggtcctgagcacaggggcttccgtctctgtggagttagatgtaccctctccaggtgggtggatgcatccaccagccagaatctccccaaactccaacttgtagggatttttatggaggcttcttcacacaggcatgattggttatcaacacaatatccagcccctctgccctctttggaggatggggtatggagctgaaaactccaagtttctggtcatggctaggtctttctggtgaccagccttcatccaggagccaccagagtcacttcatcagcacagaaaaaaggtttccatcacccagcaaataccaagggattaggagctctgtgttgggaacctcaatcaaagaccaaatatcagaacaaaagatactcctagccccgctatcactcagaaaattaccagggatttaggagctctgtgccaggaaccagggacaaagaccaaatatgtatttttattatgtcacacagctgttcccttccccctttttagtacacttcttatttggagcagtggtgagtagagtatgaggaattctgacatacccacaccccacttcctctgttgttaacaccttacattagcatggtacttttcatacattaacatgatagttctccatttgcaaagctgtagttttttcctgccatcctttttctgtcccaggatcccatactgcctcacagctgtcatgtctccatggactcctctggctatgacagcttctcagactggtcctggggtggtcacggcaggtggatagtggcctggagcttgagagcccgatacgggagggatttgggatgtgggctctgaattggtgggtttgcattaaaaaggcacactcatgagcaagttgttcactatctctaggaattggcagcccctccagggtcaggaaggccccagatgtgaaagcatcagcatacagaaaataagacatggtgactacatctaggtacctcgtataactggaatcatagaatatttgtcctttgtgtctggcatgtcacttaacatcatccaggctcatccatgttttggtatgtgtttagattttttttcttttctttttctttcttttttttttttttttgaggcggagtctcgctctgttgcccaggctggagtgcagtggcgcaatcttggctcactgcaagctctgcctcctgggttcacgccattctcctgcctcagcctcccaagtagctgggactacaggcgcacgccagtatgcccggctaattttttgtatatttagtagagacagggtttcaccatgttagccaggatggtctcgatctcttgacttcgtgatccgcccgcctcagcctcccaaagtgctgggattacaggtgcgagccaccgcacctggccgattttttttttcttcttaaggcagactaatattccgtcgtatggatatactatatattgtttatccattcaaatacggacattcctcaacttgggatggtttgactttagagtttttgactttatgatggtgcaaaagccatatacttccagtagaaatctgtaaccctggccaggcatagtgcctcacgcctgtaaacccagcacttccgagaggccaaggtggggggctctcttgaggccaggagtttgagaccagcctggccaacatggtgaaaccccatctttactaaaaaaaatggaaaaattagctgggcatgatggtgcatgcctgttatcccagttactcggggggctgaggcaggagaattgcttgaacctagtaggtagaggttgaagtgagctgagatagtaccactgcactccagcctgggcaacagagagagatcatcttaaaaaataaaaataggaaagaaaagaaactgtaaccccattgtaagtcagtcttccacttatggtggggttatgtcctgataaacccattgtaatgtcagaaaatcgtaagtcggggatcatcagctatgtcaccagcattaagtacattttttaacttatgatattgttgacttaaaatgggtttgtctggacatgaccctatcataagtgctggagcatctgtgtttgtttctagagaagataaaaaattccacttcatttctaaatcccctaggagttcactggccaataggactccctttgggggctttgggggcttctcccatctcggctaagggacagctcaaacaggaaggcaggataggtcaaactcatttgcagtaggagttgggttgaattgtgtaagacaaaagtacactttgttatgtgtgattaattgtcacagttcctgaatgtcagcacggacagagcagcagagttggcttctgggacacagtttccatctgctgtccctgcctggaaggaggcttaggtggcttgcctagcatggacttagtgaccccatctcctctcctcccggagccaggccagagcggctttgccgaagtctcggatgaactgtcaggctggagcagttcttcatccaggggctgtttcctgctctaattactgctctttcttctacagctgagaggaattggtgggtggatgtgggagaggtgagctaatgcgatgacattttgacaagtgtgttacaataaaaaataactcccctgggagaaggttaatgcagttatcaccacgttcatgttggcagccttagatctgtgcctggttggggcaggatgctttgcttttctcgtgcagaccaagtctcacccacattctaatggctagtgcttaaatttttttccagaaacatctatgaagaataaatatcgtgctctgttcatagatttttccacttgggctttttgctgtatttctttattccatgataagctacttctttccacctactagttaagtaggctgcttccctctgctctcagatgacatgtggctgaggacttcatactaacattagcctaagtaaaaatataattagtatttttagtctgcttccaaattaaatcttaccgtgcatgctaaaagagactacagagcatttgggatttatttgttgtgttggatcttctattccttgttctcctcttattcatttttagtaatgtagaatttactctagctggattagatatttgccattaagaaaaacagctttattgagatgtaattcacatgccatgtaatttgcccttttaaagtgttcaacctagaggcttgcagtatattcacagagttgtgtccatcaccacaatacattgtagaatattttatcctttttagtactgatgtgtatgaatctgccacgttttatttatccgttcattagatgatggacatttgggttgttttcactttggggctattatgaacaatgccgctacaagtatttatgtgtaagtgtctgtttggtcttaagttacgtttctcttgtagtggaatgaccagatcatgtggtaactctgtttaaccatttaaggaacttccaggctatttactaaagtggctgcatcactaccacccaacaacataggagaattacagttccccatatccttgccaacacatactatgaactgtctttttgactgtagtcatcctagaaggatcattttttcagagttggaaaatggtagagagtagttgctaaaagtataaatatggctcaggttagtacttatcactaactgtgttacctggctgagtcacttaatttctctgagccctggtctgcctatctatctgtaaataggagatggttacacctgtcccgtagggtgcttgtgaacactgactgagggggaaatgaaacagcacagcgtctcccatgctgtaatgttcaataagcgtggacctttctcatcatgcctaaaaggagaccaactgtgagtctctgcccctccttctaccctgtccatcccttctttctggaaaggggtgattgattaacaatgttttagagaaatgtgggatcatccaaagcaaagatgagtggataggaagcatcatggtgatggaaccaggagctctatgagctgtttctggatattccctgatgataattaaagggtcccctaaacacagctgagacttccattttatacttgaaaactaaattttaatgcaaaattttatcgaggttcaatttatacacagtagaattcacactttttggtttacagttctgtgagttttgacaaacaactgcagttgagtgagcaccactgagacaggagagttcccttacccctttgtgagacttgcgataggggtgtggcttgcttacttggccaccatgtgctcaaaccccttgcaggatgggaagcacgcagatgagtgggtgctggggccggagctagtgcttttgggctccatcccacagcagtggcgaggggtgtgttacaattaatgctcctttagcagttgctgtccatggatggctaggtgttaaccagctcagtggacagtcagggtgacagcttcttacaccttgtcctcttggtacccaggttcttgtccagcaccctggaagaatcaggtctcatggacttgaaggatggtgaatgcagaggttgtattgagtgatggaggtggctctcagtgggttggggacctggaaaggggagagagtgggaagataatcttcccctggagtttggctgtccccagctgaactcctctctgaccatccccagctgaattcctttcaatgttcagacacttcgtgtcttccctcctctgctgcactgctctacttctctgccagtgcagtttgggggttttataggtacaggatgggggtgtggtgggccagggtggttttggaaaaagcaacatttgagtgggaaaacagggataactgttctcatttagggccatggtgtccaggcttgagggtggggcctttgccggggaaccaccctcttctacccagtatttccctgcctcctgttcgtatcaccaccacactcaagatgcagagctctatccttttggctcggaatattcatcagctgtggccaccctggcagtcccacatcagctttctgttcctgccgttttgcatttccagaatgccatataaataggatcacagagtatgtagctcttgagtctggcttctctcacttatgtagcacatttgcgattggtctgcattgttttgtctatcagtagggtgttcctctttattgctgcataatattccatcatatggaggtaccacagtttgcatatccatttaacactgaaggatatttgaattgtttccagtttttggcagtcattgataaagccacagtaaacattgacatgaaggtttttgtgttaatatgtttccatttctcttggataaatattaacatttaggagtagaattgctggatcataaggtgaatgtgtgtttaatttccttataggaaatgccagattgtttttcaaaatagctataccatgaagttaatagtattttaatcaataataggccattggaatctctgaatttgttattagtcagttacttttctgaatggactagattctgaaactgttactaaggatgccagtaaatgcacctttcatggacagttcatataggaaaactttaggttagatgaagtgaaactgtttctttattgcaggattcttagtgcctaaaacataaggcccttaaggggacagatgaaacaggcaatttctctaaatttttttgaccacgaatgtctcatggagctagtgttctttggaaccaattttggggaacactgggctagagaacacacattcttctcagcgagtagcttgtattttatctgaaacatttctgtattggtcaggataggctctgttgtgctgcagtaacaggctgccctcgttgacagctgtttaaaacaataaatgtttgtttctcattcacgctgttagattatctcagcaggcacagggctctgcttcttgttgatctcacaggggtgtgggctgatgagaagagagtgaggctgatagcacacaggctcttggagtcttctgtgtgggagcagcacacaccacgtttatttgctgaaacaaattacatcttcacacctgacttcctggggaaattcaaccatgatatgttcctgagaaaaagagagatggaatattgaacagttctagttgccacctcagattctaaaggattcagggcaaactagtttgttccattttgtgtttctgtgtatctgagttgttgtatgagtgtcctaacctcagcacctgttgtcaccagatcccaacgtttgactatggcatatctttatctgatatctttagaagctgccctggtcccttcagcccagtaggccatcatgttctcctttatggtgaggcagagctttagaaccagaccacagagcaataagcagtacggttttagagttgggaggggggccctgggaagactgtctggcccatggtttctaaacacttcagagcgggaggaacctgtcttctaatgaaggtttaaggacagcgagcatgtaaaatagatcaaccctgaatagttctgggaggactggttggtgggccaagaattctcactgcaaggtctttcttctcccctcccccttcctacctcctcttcatccaccctagggatctctaagggccactaaagagaccagtttgagagaccctaatcttttcaaagcctttgtgtgtgttagctgaggagagtgactaggtaccatacaaatcaggttacttttgagagcaaggggccctattaaccctcatgccaggacaacaggtgtgggtggcacatggggccatctggtcacctggagagcaagaagcaggtgctgctggaagtgactggtaagatggttctcctgggtttgagagatgccatggcatgggcctcgaaggctgttgtttgtttgttttgcttttgctgttttttggtgtcattagagggagagagggagagtgtacgtgtctaccaacataaagattgaaggtgtgcagtcgaggcatccctgtgggaagtgtgagctctgatgacaacacttgttagactctctactgagcccctctctccctgttcttatttcatcttcacgtgcactcggcaccagggtgggcctcctctcctacatgcttgactgataaaacctcttaaccctgccaagccagattgcacaggagagggccttctaagctcactgcccttactttaagaggctgtggggttggtttcaccttgacctattataatatgcatgctcactgcctttactttaagaggctgtggggttggtttcaccttgacctattataatatgcatgctcactgcccttactttaagaggctgtggggttggtttcgccttgacctattataatatgcatgaagctattcacattttgaacctctccaagatcaatagtttatttctgggggacatttttagaactcttaatcactgccaaaagaaagaaaactttctggaagtgaaaactgcctcccaattacaatgtaatatacttgcctttggacctcttattaatgaccaaattcccctcggtcctaaagtccaggttgtttctgcatgcagtgtcggggcaggggaataatgagcaatgcccagcagtgcctccagagtgtgcgagcatcccagtgaagcactctggaagagctcccatgtcattggagtaagctgtgcatcacttccattctctttctcctcaaacttcaccttgagcacacagctgtgagccgtgttttttaggaatcagaaaaggtggtcttcttgggtcagtgcattgtaggaaataaatggtatattttgttttggttatttctttgcatacacttggttgaagatgacaatgaatgagggctttattttgttgagaaacagggacagtaccattaacattaccacgagaagatgctgcccaaatggggagattaaagacgcctaaaggtcaaggtcgaagaaaggaaatcccaggtgacactgccccttattttattcttacagcatggactgtttcctgtttgcaaactggtgctgccctgaagtgaggggtgagccttcttagccaggaaacagcctatacatttaagaggactctcctcagagatcaaaattgcaggtacagtctccggctgtgaaacgctgcagtgacctgtacttacagctcaggggacaaggcataagtatagttctagggcagggagaggcagtccccagagaaatttcaactggcctaagggtttaatattaaagaccctggacacagaaagatcaggggaagctaaacttagaaggtagagaagccaacacaaatgaaagcagtgacatcatctcactgcaaacaatgttaaaataagaaataaacaagaatgtcaggccaaaagacaaaatacacatggaggaaagatgttcacggaatagattttaaagagttaatatttgtaatatatgaacactctgttaaaagtggttgtttaaaactactaaaaccagaccaccagcaaagaatgtatagaaataagtcagtagaggaactgacaataattaatgttggaagacatttatctttatcagaaaacatggagaaatgtttgatcttggtaatcaaagaggtacacattgaaaaaaaatgttgtttctcagctttcaaagtaacaaagagtataaaaaagtgcacagtcttaacaagtctatggagaaggttggtggaaggctggtgaaataatgcttttgggaaccagcatgatggattggaagtctttaaaacaagcttgtccaacccgcggcctgcaggctgcatgtggcccagggaatggctttgaatgtgacccaacacaaattcgcaaactttcttaaaacattatgagatttttgtgtgtgtgaattttttttaaagctcatcggctattgttagtgttagtatattttatgtgaggcccaagacggttcttccagtgtggcccagggaagacaaaagattggacactcctacttttaaatgcccgtgtctttgatttagcgatgacatctggggatcttccaaaagaaaatcatcctgaaaacaaacacaaaaaacaaatactttctacacaaagtttccattttagtataaaataaagcaaaaaatgaagaacaacttggatattattaatagtgtggagattgctaaataagctatggtatataaattaacttagtgttatgccaccaaattaaaatggtttttatgaccacgcaatggctcatgcttgtaatcctagcacttgaggtcaggagttcaaaatcagcctgggaaacatgatgaggccccatctctacaaaatattaaaaaattagccaagcatggtggcatctgcctgtaatcccaggtggagctgaggcaggagcatttcttgagccttggagttggaggctgcagtgaaccatgatcatgcgggtgcactctagcttgggtgacagagtgaagcctgtctcttaaaaaaaaataataaaataaaatggtttttatgaagactaattcaatagaaaagtgttggctctaaaaatgaagcaggataccagatggcaagtacactaatatcactgtatttttaaaaatcttataaatctatgcacagagacaaggctggaagacaactaccagagcatgacagctagattgtgggtgctttaaaaaattttctctttttctttaatttatacatttcttgtttgttatgtatatttgtgtgtgtgtgtgtgtgtgtgtgtgtgtgtgtgtgtgtgtgtgtgtgtgagagtgagacagagcctcaccttgttgcccaggctggagtgcagtggtgcgatctctgctggaaactggaaactttggaggggacattttttcaggaattctttttcgcattatggatgccactgtttcagagtttcttaaacccagagtgtgatgaatggaggaggagagtgctcacaggatggcctcactccacagaggaccggatgcccttgttgctcaagacttccttcccccaggcagctgctacatgcttgcatcctctgtggctcttgcaatacagaggcaaggcccctgatgaaacccggcgaggtgtggtctgccctggaggacagcagccagtgtggggggcagtcccttctctctgtcccaagggaggatacagctccactgtggtcactggctctatgtgagggggtgcatgcatcagagacaacagatgagagggcccttcagttggcttttctgcctccagttctttctgttcatgagaggaaaagctactggtagacagaacaatgttaaatgtaataaaaataagcaagttccctgggtttatgcagtgccaaatgtcaagatggttgtatacaggagaagacgtccaagacacgtcttttccgagtgtcccagagctcagaactctgtgagcactttgagcttccccagacctctttcttccctgggtgtgagccctgcacagtgctccgaaaagagctggggtccgtaaatacggatggcaaacagctcacctgggtttctcacatggatttgttttcttgggggtctctgtatggaagcttttatcccttcctagggggctataggagtatttttgttaagattcaatgggtcatttccaaagtagtcatttctttctcctcacacaaaaatgaactgaataagaataaggatacagttttctagtgaaaattggggtcttccctgctccttgcctccaatcaagtaaaagctttttagaacaaacggactacaatattctgaagtgattttgaatttggccccatatttgactctgcggtccgatgagggacacggggttagtgggcagacaccattgtttgcacacacgagactgggtacagagccaggcgtgatcatccaggataacagggaggaaagagaggccgatgaagccactgatttttaagagctttcttggtggagtaatagattttagggagggagttgctctgccaagtgctccagcttaaatggagccacctgtggaaaggagctggcggcactgctgtgggagtcccttgtctttgggaggggtgtttcacggccacctgcctttcatccccacagctcacagcaacttacagaatttccgaccgtctccttggagacttagagaaatgtgtgctgaaggtgaggagtcactcaatcactggcagccaggcggaggtgactgatagcaaaatgtgctctagttgtagtggggcttgcagctgggtatcctctgtggaatgcttgctggctcatgatagatgagtcacttgtctgtagtggtggccggggctctggcccagacccttctctgttttcttatgtgagtgaaggctgttgtattgcatagtgggtgaaccacacctggggattctagacttggcactgccctctcttcttgtggaaccatggatcacccatttatcacctctgggcctcagttttctcacatgcaaaatcagggttgaagccaggcatggtggctcacgcctataatttcagcactttgggaggcccaggagggcagatcacttgaggtcgggagtccaacatggttgaaacctcatctttactaaaaatacaaaaaaattagtcaggtgtggtggctcatgcctgtaatcccagctacttgggaggctgaggcaggaaaattgcttaaacctgggaggcggagcttgcagtgagccaagatcgcacctctgcactccagcctgggcgacaaacaaaaaaacaaacaaacaaaatacaaacaacaaaaactaaaaccagagtcagggttgggcttgatggtccctatcagtagcagagtcccctggtgtggcactttgacttgtggataaataggtttttcattgctgcagtttcaaaccttcagcttctctaatatcccctgccactgacggattatttcacacgaaccagagaggccattaggtgagaatgccttcatcttccctccctcccacctctgagcacccttctgtttccttctgagcttcttcctatttcctcctgtcgtccttctcctctctagaccctgaggggtttctcttctcttctaaggttacttcttcctactggactcctgacacccccacccccacccctgcccttgggaacttgattccatctctctctctctgtctctctgtcttgctccccgcttcttttctcatgttccatcttctttctccctcacctccttataatccacatccaaacaagtccacatctccccaaaaactccatgcctcccttttggccaaaaagaactctatagagcatcagaagaataattactaaaaatatatgtttaaaataagtggccttagtagtaagctctgagaatgagaagcttcattgtctagtaagttaatacaaattagtcgacagtcaatgatgacaagaagagagcgaaataagtttgtacttacatacctcaaaacaaaaactctctgaaaaagcagtttgtttgtctcttgacctaacaattccagcctaagaatataacaacaacaacagaaaagacaaattcatttgtagtaatggccattataaaagatggacggatattggagcatttgaagtggaaaaaaagtatacaaaattcatcttgctgtgggaccctctccccttttctagggccatatgggtatagatgcattgggggaaaaaatggctggaagaaatactttaggaatgtcctttttttttctttatatcttttgaaatttcctacataagctcgtattacattttgttggcagaaaatcagatttataaccatccgtcctccctcccacacaaccttcttccctcccacttggcctcaggcattgaggtttggcttggttcggtcagctctgctgggagggcccctgggactctctgtctccccgcctcgccatggtgagggttcggcagttctctcccccagtccctgcagtccctcttctctggcttctgtatctgccagttttctgttcccaccctgcgtgtttccctagtgtcttgaataatttttttttttttttgagatggagtcttgctctgtcccccaggctagagtgcagtggtgcgatctcggctcactgcaagctccgcctcccgggttcacgccattctcctgcctcagcctcccgagtagctgggactacaggggcccaccacctctgcttggacctgagacacgatgttccccagagtgctgctttcatggtggttttcttggcctgacacctgtgagtgatcagactgggaaagaggattccctttcccagtccttcgtcctgcaagtggctggctctggtgtagacgggggtgtcataggtagcctgccacacagggtggctcctctgttcgcctcctgttttccctggtcatggtgggctccctgaggaatcacttcccctcttgtctgtgttggtgtcctagcttaggtggccccttttcctgctgttctcaactttggtagcaccttggcaccatctggggagctttgtagtcctgaggcatgggttccccctagcagttttaatgtcaccaattgggtggaagccaggcctgggagtctagaagctcccagctgagtctgctggctgctacactgaggaccttgtctcctgtctgtgtcgtgcctcgttgcagatggtcacacccatagagcagcccgtgcctagagtcctgggccttggggctcagaatggggccaggccttcctgctgagccgccccagtgacacaggcactgattggccactggagaagcgggagtgaatggcaacaaggccaagtgggaagcctgtgtctgcactgaccaccgtgccccaggccggcctagcccaaagagacctcctgctttgacttttccttactgggctgtgcctaccttgtgaaaactccagtaaaattaatccaatggctgcttggccagacagtcaggacacatttcgtgagccctggtctgggctcagaggtttggagtccacagctgggccttgatcttctttccccagtgacgtcctcaggctggggtgtggcaagtttggagaggatggggaccctcactctgtggcccaaatagagcaatagggcctttttcttctgcttcagattatctattctcacaaagggaacaggcatccaaaaacctcacagaacagcattaggaaatcaggaattgcagccaaaggactcttgtcctctgtgtgaggctgagtcggacttccgtgactcatggttctgttattctgagtgtttgagactattaaggaaattgaatttagagtgtcgtgatttgtgagaacaatgaaatcggctgttcatattcctgtagcgtcagcagcagatgagatgggaggtgttgtctttcaggcagacaattgggagcaggctattgccttgtgcaggtgtcttgtaagggctgaggaaagcttcttgaggtctgagcagtagctgagaggtctgcagatcccctgcctcagtagagggacccatcagcaactgccagtcctgggccagagccggcgtcagccgtacaccgcatggatcctgagactcccgtgtgcttttgcagccctgagattccatgtgcttagtctccttctgttcaccccttaccagatattcccggggcacatgctggagtgcctgtcctttcttcttgcatcaagtgtgtggtggcaaatgaggaagggattttcgtattctcctcgtgtgcattccagccagggaggccaatgaacaggaaatgctcatgaaaaaagtcagatggggcaggtgacatacaggtaattaacaccatgggaacctataatggagaatgacagagaatgacttttatatttggtggctggggaacatttttaaagagatggtgtctaaactgagagctgaagatatgagtggtgagaaggggccagggaggcaaaggtcggggacaatcgcctggtacagggagactaaggagagattgagcatggtgttttcagagaacctcggggtggcccgagtggttttgcaatccaggaaaggagtttgggacatgttctctgtgcgttgggaagccattgaaaggctgtaatcaggacaatacgtgatctggtttgctttagaaagatcttgagtgagtaaatagatgagtgagtagtgagtgagagaggcttagacaccagaagagctcatgccaccgacatgcagccatgggcacttggtggttctgtttgccctgcccagctcatgtgctcataggtgaagtttttgccatcagcagtgatcattaaacagtgagatgggtaattgtagcgagggtattttctctgttggtcctagattgcctagaatcctgatagaaagaatagttttccttgaacttacaattcagcaaatcctctgtagctattttttttgtactgtttgaaggatgtactatttatggactgcaaaacaatggattctaatccgagctggagataaaacatgacgggggcataaaacatttaagaagcacacaggaggtacaacaaagcattatgcaacagcttcttcaggcaaatgtgcacattttgcatctaggagcaggtgagaaaagtgacacagagcagaattgtcctaatatataaacctcaggtggtattatgaaagtaaatactatattcagtctttaggcaaaaccatcagtactgatttttgcccatgaatgcaattctgtcttcctgatgtgttggaactacccccaaacaaatgccaaatgtgagattgaaaattaaatttatagggccctaagctgtttggaactgtttttaagatgagagctgttccacctaatagttgctataggaataagctggcaggatgaggaaaacccaagaatgccagttagcaggagaagatatcggagtttctgttaggcaaacacagggaggaaatatggagatggtattatctgcagcactgagaatcacagcctctagagacaggagtcaaagtcactcagaacctcaatgcccgggcccttgaggcagcctgtggcccagggcaggtgcccctcctgctgctggccttggaggggtggcctgagaacaggggaggttttacacacctttcccactgcagcctgtgccatcgtcatattctgcagggtgtggacacaagttagaagcaagacaaagttggctggccctgagcttgcccttgggtttgagacttgatcaggtgccagtatctctatggagaactgtgagtacagttcttgctgtctttgttgttggatggcgtcccctttaagtgtttagtcctgttgtctgggcagccttgtgctgagggacccattgctgagcagagtgtgcccagttctcagcagatagaatgagagcccctccaccatctcacgggaagctcccctgctggagcccacttgggttcttgccatgtggcttctgtgctcctggtgaatgtatagctcctgtctctctagggtcatcttactggctgctctgaggttttcagaccacagagacaggagtagagctgtctgctgccatggtcaaggtgaggcccatgcctgtggtcattccctctgtccccaacttggggacagtgtcaacctctgctgtaactggaattccctcttggtgctttcatgtaatttttgtttctttgtggtttttgtctggatattcagaccctcagagtctggcaaaataatttgcacattagtgcttcctatgtgagttgattattttcctttctaagagtcaactagaaataaaaagtaaattaagtttttatttttattggacaaactgcacctctagcctgacatgttattataggaacttgggctttgaggagacaaatttaagtctatatataaaataactttacgagttttcatatttgcttcttatcccttgaactgagaccatatttgttaagatttctctctgaaattggccacaataaatatcttaacaaattcaggaaattcattctaagtcatcatttttgctataattcctggaccttcagattttctggttaaagttgcctcagggggaccctcagatctttatggagtttgtaaatccatcatgagagattgaatctagagtacttaacacttgaaatctagagtacttaacacaatcccgggcatcatttactggtctcaggaaatcctttgagggaacaaaaaaaaattactgctataatgaaagtctctaagctggcttattcacaaaaaaccagtgtggtgaaacaaaaaaagagcatggatttttgaaatcaagacacctggattcatacttcaattttacacctaggactgtgataacattgggcaagttacttagcttctgtttcttcatttgtgaagtgggaggatacctgctttgcagggtggttgtgaggttgacagaggctgccttaggcttttcaagctgctgtaacaaaataccgtaaacgcagtggtttaaaagcggcagcaatttatttcccacagttctagacgctggtcgtccaagatcaaggcactggcagattcgatgtctggtaaagactggcctccaggttcacagacggtgccttctcactgtgtcctcccatggtagagggggcaaggcaactctccgaggcctctttagtaagacactaatcccattcatgagggctccaccctcacgatccggtcacctccccaaaggcctcagctcctaatagcattaccttggaggttaggatttaacatatgacttttaggatgacacatacattcagtccattgcatactccaaggaatatcatgcctaacaggatggctggagagtgtagatgtttcaccactgtagtaccctccagccttcctttccacacacagccagtgtatctccctgcacgtgtcttatttgacctgtggacttaacgtgcctggtggaattgccctggctcgtcctaaggctggatgtctctgctcagatggactgggaggcagtggggatgccggggtggagatgatacctgagcctggagagcctcgcttgctctgagttgaactgcagtcggatgccctagctcatccacgtgcttctgttgtgacagcgatgctgggggtgtcttccttccattcggtggcacaggtttgatgctaggacccctctgactcagggctccaggccaatgctgcagctcagccttgaggaggcgttcccagagcatgaggaggactcatggtggaggatgctggttagtctctttctggtcggaccctcactttttgagatgatgtgacatctttcctgtagtcacaactacattcaactctaaaaccattttaatttttcattttcccctgtttggggaattgtaatcccatgggtgtatggatattatccagagacatgaaacatggagtttgggtttgcagaggacaaggaagctatgagataagggagaacagaatgaagtcacaccccacacagatgcccacagattatgtgctgcagtgagtccttaatgtcctggaatcggtgacacaccaaggatggctttcaagagctttcttgagccctttatccaaatctctgcagcccctccctgaacttcgttagtttctagatcagtttacttcctaagtaacctagcacacttgtgtaagaccagctgagcttcccagatgatccctgaacgtcacggctcctgaccgttcctctgaggacacttcctggaagtttttgtgcaaaaccattattcttcccaccttaaggcaggcatgggtggtcacgtgtcagtccagcctgctgtgctcttcctgtgcagaaactcttgcctggttacacttggcgacttctctttgtaaacaaaggtgtgagtgtccttaacacctcacagttgacggactggctgcgttagctcttcctttgttagtttctgattgccagtgaaggagaacatcttctatatgtttttccctgtatcagttaggatttgctgtataacagaaacccaaaacttagaggcttaaaataatacctttttatttaactcactgttgtgtgtgttggctggggttactggggcagcaaggatggcctgggttcctctccacatggtctcttatatcccccaaaggctagcctgggcgtcttcatgtggtggactgaaggtcccagtaagcaacaagaaaaggcagactccaacgtgcaagcgctttttaaacctccatctgcatcataattgttgttgtctcattagccaaaggaagtcacagggctgccaaatctagaggcaaccttggatggaatattccaagggcctggatccagggaacatgaatcaattggaggctgttactctacaatccaccacaaagtccactgcctgttttcttttgattgttgatcttttatattaggaggagtttttaaaatatattctggatattaattctttcattgctatatatgttgattcagatgaataggagttcttacttttaataaacaaggtcacttctctcaatctttttcttttctgatgtgctcattttggctattgttttaaaaatcttccccacccttgaagccatacagatattcttcttattgtttcctgaaagttttatggttttgcctctcatgattatgtgttatcgctctcatttttttccttttggtaggataattaagaagtgtttttattaggtaagctccattttctcactgcatcaaagtcatttatgcaggcctgctctgcaagtggcattttccaagtggaattaaatggatgttactaccctgtagttaattccagtctaagacaattgcaatgcagacagaaaccttgagacattaattgaccaaacatgtatattaaataggtttgaatattcaagtgcaagcaaataattagtacacttggtgagtgaagagaaaaatgaagtactgcatttctttcctttccttctttccttgcctccttcttttctttcttcctttccttctttccttccttctctctctctctctttctcttctttctgtctttctctttctgtctctctttctctttcgttttctctctttctctcttttctccttttcgttttcctttttcctttcctttttcctttcctttcctgtcctttcctgtcctgtcctgtcctgtcctgtcctgtcctgtcctgtcctgtcttgctctgtcacccaggctgggatgcagcctccaactcctgggcctaagtgatcctcccacctcagcctcctgagtagctgggactataggtgcatgccaccatgcccagctaatttgtaattttgtgtagagaccacagctcactatgttgcctaggctggtcttaaactcctggcttcaagcaatttccctgtcttggcctctcaaaaaaggattgattacaggtgtgggccaccacacctggccaagaactacactcgttaacttcagctaagcaactcccccccgactcctaccctgttctttcttcaggtttctgttgaaaagttatttggtaaaagaagagggcctgagcagtgattcttaagatggagggaaggaaacctaacacataatctttgcaaaaaatccccgagcaagttggtattattgccatgactacatgaggaaaccaaagctcagaggatctggagaattgttgagcaaggaacccttccctcctgcaccagatctctctctctttctctctttctctttctttctttctttctttctttctttctttctttctttcattctttctttttctttctttctttccttccttccttccttccttccttccttccttccttccttccttccttcctttcctttctttctttttctttctttctttctctttctttctctctctctttctctgtttctctctttctttctttctttcttgacagagtcttgctgtgtcatcaaggctggagtacagtggtgcgatctcagctcactgcaagctccgcaagctccgccttccaggttcacgccattctcctgcctcagcctcctgagtagctgggactacaggcgcccgccaccgcgcccggctaattttttgttttatttatttattttttaatttttttattttttagtagagacggggtttcactgtgttagccaggatggtctcgatctcctgacctcatgatccacctgccttggcctcccaaagtgctgggattacaggcgtgagccaccgcgcccggcctgcaccagatctctaccaaattttaagtcagtgaaatataaatgaaaacttgttatttttaccatgactgacatcagtgtttttgagggcaaaacagtaggtgttcctttttttttttttttgtctaattagaattcttgtttttatctgtccttaaggtttttctctgtctttaaggtttttctccactcctaggaatgttccctaaggttttgatataattcaggaatttgtatttagggaaaggcaactgaaccaagttacgagaatgtttagaactttggaagccctggggaagacatctcgcccattgctggttggacagagccaacgtgggggtttctaaacatgcacaagctaacagtctccatcagctctgaattcacttctgagcttagcaatgtaagcttgtattatatacaacttcgtttcttcatgaaacaatcatcataataaattttgatatactcggaaaacttaccaggtttaaatatttattattattattaaaataaatggaataataatggactggattttaaaggatctagaatttgaccgtttttctttttcaaaacatgataaatacagaaaaacctttaacaaaataataacagtaataataataataatagtggtatgtttcctgggctaaatttagaaaactattgagtatgaggcaaatatggaaaacatatttatatcaaaggaggacctagaagcaaactaccataacttgccaaattcaacttctatgtttgttataatttagtaattagctattttagaaaaaaaaagtgcttcaatagggaattaggattttcagaattttgaagccctgggaaataattatatccagtgctgtttaggtagaacaaaaaatcaaatcacttacctggagtaaatccaaaaaagtgaaaccattttaaaaattatctttttaaatttctaaattaacgttgtttaggcatatacattgcattctgtatagctttttttttcaaattattaatatttttatttatttattttttttgagattgagtctcactctgtcgcccaggctggagtgcagtggcatgatctcggctcatggcaacctctgcctcctaggttcaagtgattcccctgcctcagcctcccacagtagctgggattacaggcatctgccaccatgcctggctaatttttttatttttagtagagatggggtttcaccatgttggccaggctggtctcgaactccttaccttgggttatccacccgcctcagcctcccaaagtgctgggattaattacaggcgtgagccaccatgcccggcccaaattatctttaacaaagaattagagagatgcaagacacccggcctgccgcgggagcatgagggagtctgtgcattcctttccaaggcatctgtgagtgcatggagtagacaccatgagcaaagctcaccctcccgagttgaaaaaatctatggacaagaagttgtcattgaaattaaatggtggcagacatgtccaaggaatattgtggtcatttggtccctttatgaatcttgtgatagatgaatgtgtggagatggcgactggtgggcaacagaacaatattggaatggtggtaataggaaatagtatcatcatgttagaagccttggaacgagtataaataatggctgttcagcagagaaacccatgtcctctcttcataggttctattttactatgatgtaaaaattaggtcgtgtacattttcatattagactttttgttaaataaacttttgtaatagtcaaaaaaagaattagataatactaaaaaataccaaatatttaatatttttaataccaattttctaatccctttaaagtacataatgagttttaagaggatgggttccagggttctagactttgagttctcaaccttatgttcttaaatcggcaaaagtaccccccaaataaaacaagataaaacttttactgaacacaatggctcacgactataatcccaccactttgggaggccaaggtaggaggatggatcacttgagctaaggagttagagatcagcctgggcaacatatagagatgccatctctacaaaaaatacaaatagctgagtggggtgtcacaggcctatagtctcagctactcaggaggctgaggttggaggatggattgcttaagcctgggaggcagaggttgcagtgaaccaagattgcaccactgcgctccagcccaggtgacacagtgagaccctgtctcagaggagaaaaaaaaaaaaaactttcaacattataatttaaaaagatgttttaggcttaatttagaaagtttacattgttcaacagaagccgggtttatttttagaggaatagttggatgcaaactctcaaaattttctgaacttaatgtttacttctgaaactgcttcctcaggcttgttttataagctttgtctttttacaggccttcagttttagctttatcatgggttgatcagccgtcctggtgttcctgggactgaggagtttcttgggatgtgggactctcagtgctaaaaccagggatatttcaggcaaactagaatgacagaatgagttaagatggattatgtcctgataaacccatcaatagttggaagtatcataagttgaaaacgcatgtaatacaccaaacctacagaacctcatagctcagcctagcctactttaaatgtactcagaacaatatacattaggctggctaatgtaatcagcctacagttgggctgaatcatgtaacacaaagcctgttgtataataaagtgttgaatatctgtgtcatttacctaatactgtcttgaaagtgaaaaacactggttatataggtatgtgaagtacagtttgggtattgtattgtaccatcataaagtagaaaaatcctaagtcagcccatcgtaagtaggggactgactgtagtcaatcaccctattcttcttgaacctcaaaaagcaaaatccatcagtttaaatgtagacccacatgtgtagcctttactttttttttctttttttttatttaagagctagagtcttgctctgttgcccaggctggagtgcagtggtgcgatctcaggtcactgcaacctccacctcacgagttcaagtgattctcctgcctcagccttctgagtagctgggattacagctacgtgccaccatgcctggctagtttttgtatttttagtagagatggggtttcacaaggctggtcttgaactcctgacctgaagtgatccgcctgcctcagcctcccaaagtgctgggattgcaggcatgagccactgcgcccggcctagcctttaaatttgattaaggtgctttgattagtttatttccttgggaggcagaagtgtttacaaagaagaggccccaggataggctgtgtccatgtggtttcaggacgtgggcgctgctttccgggtgggctggtgagggcattttttgctgcccagctctcatgtttcccaggcttgctatttgttttctaatccaggcaacagaaataccacttgtgtccatgattttcatgctggatctaagatgttgaggcagcaaattcttattctgactaatttaacagtctttcggtttagcctgtgcttggggctgtgcttagaattttgataaaaatggttgtatctgggtcatttggaaaggaatttggctgtctggaaaatagaacatataatagaacaggtggttattaaagcaccaggccaagtggagaccatgatttctctttgatttagatgcaaagattgctatataggttgacacacaaagatttataatttgtaatttaagaaaataattgttcagggagcagaaaccagaaagtaatgtatgagtattttttcttgaactgcattttcttctttctaaaagcatggaagtctttaattccccttccacagctcttaaggctgtcaaatgtattgggaatggggcctggcccctgagatgtgtaggttatacatcatacaactcaggggccaggcaccattcacatcacatttatcctagatttgtcttgaaggggtgctttttctgacccacatgagaatttccctgggctagtggcagccagcatgactgcctcaccaacccctctagcaaggactcttagaggaaaacatgaagaaaatcacatttttcttctgttagcattttatagacttcttcactccactccagacctttggatgtctgacctgaggacaatcaatatgtttttctagagtttttagcacgcagcagcatagtggcttagagtgcagaccaaggagtcagtgccataattttctacctgtataatcctgtgcaagttggcctctctgtgcctcagtttccccatctgtaaaatgggggcagcacattcctcattggactgttggggaggttaaatggattaatgctgtaaagtacttagaatagggcctgacacattgcatgtaaatgttaccagcctcgttcagctttgcctctgacactgagctgatgtacctgggtctggcaatacaacattgtagatgctgattaaaacttgaggcacatgtgaagaaaccatgactattcccatgaccccgtgagaaggttggtcaaatagtttctttgtcttctgctgggtttcacttcctgctgtctcagctgtaccccctaatgttggtgtgtggttgtctctttctgtgccagccgctcccatgagaggagcctctcattgccgggactttagtggctcgggacagtgccccatgagcgctccagttaagccaacagatgggtacttctaggctggaggcactgcctcgccagggcagtatctgctctctgtggatgtccgaattctcacgggtgggctcagcgagacagtacgctccatgtgacccactctggtctcaaaagctagaaaaatgctctggaaggatattgaacacctatgtggggctctgtggttcaggttaggttactccattagatcatttgtatctggaaagaacagggatggctccaacactgtacaagcctgcagtcctcctaaggctaaaagacacaaggtggtacccgtgtcatggtggtgggaggttaaagattagtgtttgtgtgtgtgtgtctgtgtgtgtacatgtgcacgtgtgcaactcttgctttgtgtgtgtggcatttcactttcctaatcaatttaggcaacctgttggggcttcggaatagtgcatctaggttggaagtatctcccagtgaatgggtcacactgtcacactgggcttccagcagaccccataccacccaccggtgaaacttgagtaaagctactctaagaatacagagcattggagaagtgctttattcggttaactttaccaccaccagggaatgtctgggttgttctcaatgatcagtatgaaggtctgtggggttgtggacacattcagggttggactggggttcgtattagtcagccgactgggtatctttattcacagaagaggcaaaattagcaaataaccccatcaaaatcatcttgatagttgttctcaccaaggttgctatcacctctataattatgaaaatgttttatgaggtaggcttgggaatttgaacaccttttgagaactgttgggaacaaccttctcagttaagtaaagaaactacttaccagaaaacatgtggaggacactggggtgataattcatggtcatttccgataagctacttctagggccagaatctctgctgaatctcagcttcctgatttaatgaagacaaggaaatgaaaccgccctgccgactgtttgtgcttttaataggccgagttttcagaaagagaagacagttaaattagttttcctttttgcccttttcattctccctgcttctgtcctgcagatcaaggcctttgaaaggaaggggaagaggaagtgttttcttgcttagtgaataggatgcacctgtcccctgaggaagattccctgtgtgtgcttgtatgtaaatgtacatactctcttactgtcctctttttcctcctcacaaatgtaagcctgtatgtgcttcatattaatacttggcattcccatgagcctgcaaagtctggagggagaggccaggcccgtgcttctggccgctgtgacccagcacctggcggaggccctcactgagtcctgtcccctgagtggaggtgaaaggtagacaaggaagaccccacagttggagagcctgccatggacaggtcgcgcattgtttcacttgggcctggttgagcgtattactgggagtgggggaagttgacgctgtgacgtagtcctggggcgagcttggaaggtgctctgggcttgtcagttgacagtgtgtcattagggatatgagcggcaatgcgatgtcctcccctgcaaggaaggagatgtttcagacttaccattgactgaaacagggagacgagtgctctctcatggaaacaggggagatttgagatcagtcacaaacacttaccaaggcccaggttcagtccactcctggagctttgaggggctagtgtgtaaagggcacagaagcccttttgctaggtgcactggcctgagagcttcgaggggatttgccaatgggattgtgccacaatttttattactttttccctagtcttcgtggtctaagttttgttttctcaatctttcttttctcatcttccttgtgtggagttaacttttaatcagggaaagggaatacatcgagctattgatgaatgaatcactggagaaaacagtgaagtgggatttttatttcagggtctcttaggtggcagtgccgggtgacaggtgggggtgtcccttgtcttccattgtcccggagactaaccatcagcctctacctaattgaatggcatttttatgtgtttttcatgaacggtggtggatggagatgtgtggaggactagcagctcttcatgctggagggagttattccgcctctgctctcagacagcctgtgaccaggcacgggtcacattgctgccctggacttgcactgtatggcatttgaatgtcatgtaggggcaccgtgtatttcagtggctgtgtctaggcagcccgaaagccactgaatccctcatgtccactctgcagccgacattcactcagcatcctggaaaagtgcccactggggcaggagcttctcttgctcatgtggacatgacggtaagtccttcttggagaggcagcatcaagtcatgttgttcgttctgtggccaggaggtacaaagtcagctgtttctgcttttaagtgatgtgggcttaaggaagagggaaggaggaatgaaggaaagaaaggaattgaggagggaatgaaagaaggagagggagggagggagaggaagggaaggagggagaggaagggaaggagggaaggaagggaggaagggacggagggagggaggaagaagccccatggctttcttgtaaatagcagctgccctgaagtctgtgaagggcacaccaagagtctggctgggaggttgtcagctaggaaactgtggcccaagttcgtggtgagtgaggagttactttcttcccttgaccactggagcaggatagactctgcctgccacccatcccatgaagaagactttccttctgagtgccttggtttgcgcttcagggaagccactgacacgttcattacctgtttcctgaagtagacagttagagctccctgtctcagtgtccaaaaaaaccaaggggccccaagtgcagaaacaagggctgaaaatgtatgttttacggacaggagacagccagcctgtttaagtggaggcttttttggaaaccccactttcccagtgagtcacagtaaacacagacagagcacactgcttctctgacaccagggccagggctgtcctgggctcagaatgaattagaccagcttgccttttgtgttcaccattctagcatttctttccctgcttgattgtcaccacatgtgcacacacatacccacatacctgtgcacacatgtacactttcttatttgctgaccctcacagccctgccatccctgggctaccaggcagactttctgatctggagcttaaccggcccagacattggaaacaccaagcaactggtagctggtaagacttttaccccatcaacgaggcttacgaaagagtaaacttaccttaataatgcctagtggccaggtttccaggagtgggggacagcctggcgctgtttgtaggggctgaagggaatgtttactgaggggatcctgatgcagtggccgctgtgacagccagtcaggaggtcttgtccccattctaaagagcgagaaactgcagagttgagaggaccacaaaccctagtgcagccgggttttctgcaggggtctctacagctcagagcctctaggctttgtcacctcctgggtattggaggcttcctcgggccctcagcacagcccacacctaccagggccaatccaatcatgtaggctggccagggcggtgagcctccgaacaatgtatgggtggtgccaccaatccttgtcctcactaggaatccagtcagtcatcccgcaattccccaggccgggccacagctggctgtgctcctaacatccctgcactgaccagcaggtcaccggtacctctaggagcctgactgtgtggcagccgtgtctgagtgatgactgccagaaagttctggtttgttattcagacatataatacgtgctgctttgaagacagtggcctgcactgctgttgtccttcctaataggggtagggtcttgccaggtcagagcaggacccatccaggggcagtgacctgtgctgatgtccttggctgtgctggatttgacgagaacactctgtggtcaggggttttgcctttcagctcgagctgcagagagaccctctctgtcctgctgcttccccagattctgcccacggggcatccgcatgccctctctagctgggtgaactatgtggggtcagctcactgtgtaggctgcctcgggaaggagggagagccttgtgctgccagggccctagtttccatttggcttcatcagagagtttctgacacatacctactgccagatcacatgtaatagctgcaacatgccacgcggcttgtggctgaagttacttacaaaagccgggttgaggaatccataaagtgtaggcttctctggccttcatgggtcggattaaagggtgtcctggccctgaggagcacccagacctgcagctgctgctggctcctgaacaactggctctgagtgtgcagaggcctggctctgacagttgagcctacctgaagccctctgagaccaccatccagagccggaggcatcctacatacctgcatgcaaggggaggctgggcctccaggtctactctgttgtgatttctgctgggttgtgtgacggtggtgcattggctattgtgggcctgttggtggactagagtccttgattttccttctgtgcaaagtcaggactctccggggcccttcatgccttaacatcccaagaggcttgttttgttattttcttccacaatgccctggagttaccatgtttgggcggcatgttatttatggagaagttggtgacagggagaccctgatgtaacttgaattgtgataatgtctatacttgctctcacggcctacggaagaagaatttgtttttcttgatttggttcttttcacttctttttcttcatggaggcttcacgtaggtgcatgtggagggagctttattcagacaagtttccttgacatctctgggaggtctctgtttgtctggctctgagagcatctggtgtttggacagcctctgggccgggcgctgtggggatggctctggaaactgtcagtcatgtgtgtgctacaccgtgcacaacaggggctctgcagatgatatccatgttctcagacgcccaggggttttctttgcttaggttctcttttcttctccggccagagatatcttttccaagtagtaattgtaatttttttggtggagggttatttgtgatgtttatctcaaccctgggaatacctttttgagagtagagaggctctctgggatcttttcattttctaaattctcagtgtatttagggaataaatgcattcccgagactttcctggcggctgttgataagcctgcagtgcactactgatggttggcagccctgtgatttaccgtcctctccctagtggaaaaccatgcaaactgacgcctaaacccaaggcgccatgcacagtcactgctgatcccaagtgctaggcaaggcccaggtgaggtgagtgagggagacctgtgacccgaggtcagggagctgcatgtgcccttccaggaaccaccaaagcaggagagcaggtgcagttggcttggatgggttcagggccagagaaaggtggagaaagcatctgcctcccagtggctgtatctgggttttaattccagttccatacttaccctctgtggagcttagcactttcacttgtagcgtgggcacagggacaccttggtcataggcaagagggctcccgatcttgtatgtggagtgcctgatgcaggatctgactggtgaggtggcccatggctgagagctgacaggctgtccagggccaatggaggcccatgggagaagcggcctgcagagggtgaagagaagacttgcaatcttatggcctgatactgtccatgggcaatccagggacagaaggcacggaaacttcaggtgaccctagcgtgtgtctgaaccaagttcctaagtgcatggtttcaggggagggacttcttcctcccctacagagagtaatggaaggtaaatggttgaagccaggcaggcaggtgacttcagaaccccatcctgcctctgctgtgagaggaaggccactctgtttacaagcagtgaggctggactgtttgaggtgttctcagccccatgtgcccttctctggatggagagcctttccctccctttagagggcactgtgtctgcaggaaggaggtcagtagcatgagcacttggcctgaagtgtcttacacgggtccatttctgccaagacgcccaatgggggcccaacagccaggcccgtgagctagccttctgttgtgtggacacatcaacatttctggctctgtcacacaggtatggtcagggccctttgtagttgcataggtgtaaagcgagggccctggctgatggctcttcctgtcaagcagaacaaagcaatgatgtggaggtgattgtcccctccccagggctccaggaagccttgatccgcacactgtgctgaacagcacacagcaagagctctagttaatcatgaggattaaattgtgtttgttttcattgtaattacagcagagcagtaaaatgtgcagtctgtggagctggacaggcagaggtcaaggatgtttgcttcttggctttggaggtgtcagacgtgtgtgaaatatgctcagcctcccacctgtgtgtgcagcagccaggcacctcccatctcccagggacaaacacaaacaagtgcattcgaagggaagggtgtgcccagaaagaagtggcatggggctgcaggtggtgttcagtgttcattgagactctgatggctgtgtgctggccaggccccatgacgacaggtaaagcttaggactcttattgaattgggtgtgtatttaaaatttggctcattgagaatcagtgtaatcggcaggcatttcaagcctttgtcatggatttatacagtgtttgggaggtgggtcaccctactggtcagcctccccaccccttcacttatagtagggaaactgaggcttgccttttttttttaaatttattaattgggctctctgctgatacgagacatgttgatgcattcagtgtggtgtgtattaagatctttactggatgtgtagcattccacttcattacatcagaggaagggccacaaagctctataaaaccaggtcccctaagagtggctagagcaggagacaggtcggtggcccggctgctgatgcaccagccccaacggtgccagcaagcatgagcaagcccacaggtgccctcggcctcagggcaggaaagccctgggaaatgcttattattacagtgctggggtctttcctgttatggttacagttgtatttgtctaacagtcttatttaaagaagaccaacatcatgattctgcatttaaccatctgaggcttgaaagcttggagagaaaccagttgtctaagtggtttgtaaatgggagagataaatgtctcgagtaaccacggtggaaaagcaccaggagggtggtgctttcactgtacctgggggcagccatgctgattgcaggagctttggggttactgccttcaaactctgctttcgatgccctgggaacctctcatggtgcctgtggggtacccaagagcccataggacagtgtccggaggccccactctctgcagccaggtaaacctacccaggccctttccttgcggcctcatccttcaaaggttttcttgttttattattttacgtaatgttgtttcttttaaagaagctgagaaatgaaagagcaattgtatgtctacaacttttgtgatattaaccttattttgaatttctggtttaccccatttgtgttggtgcattcaagttattatcaggagataattctttatccgcaaatagctttgttctcacttacctccttggttccattattggaaaatatattacatttatatatgtaatgggcccaatgataaaattatatttttattttcatacaagactttcttttttcttttttatttttttgagacagagtcttcctctgttgtccaggctggagtgcagtggcatgatcttggctcactgcaacctttgcctcccgggttccagcaactcttctgtctcagcctcccacgtagctgggagtacaggtgcccgccaccacacctggctcgttttttgtatttttttttgtatttttggtagagacagggtttcaccatattggccaggctggtctcgaactcctgaccttaggtaattcacccacctcggcctcccaaagggctgggattataggcgtgagccaccacgcccagccgcaatcactttgttaaatgagttaagaacggcagagacatgtgcattcatactatcttttataatgacccggctgtctttactagtgctctttgtcattttatgttggtttaaattattatctgtggtcacttgattttagcctaaaaaagctttcgttgctattttctataaggtgggtagatcaactagcatcagattttctcagtttttgtatatctggaatgtgtttattttgtctttattttttataggtagcttttctggttgtaaaattcttgattgacagccttcaatcaaataagtaatgaaatagtagctagaatatggagactttaaaatgtcctctgtggattagggggctgatgcatacatagaaagattgattctctcagttttattcctggggagccaggtagagaatttgcttttaggaggtggattttcattccttgagcaaagctaatagatgaacttagctcattctgccaggacagtctgtcagtggagagactgtactattaatagaaaggaatgtgaggccgggtgcggtggctcacgcctgtaatcccagcactttgggaggccgaggtgggcagatcatgaggtcaggagattgagatagacctggctaacactgtgaaatgccgtctctactaaaaaaatacaaaaaattagctgggcatggtggcgggagcctgtagtccccagctgctcgggaggctgaggcaggagaatggtgtgaacccaggagacggagcttgcagtgagccaagatcgtgccactgcactccagcctgggcaacagaacgagtctccatctcaaaaagaaagaaaggaatgagagctggacaagtcattccctggtcaggacactccagaagccctacatggtttgcaaaaccatctgggctgttccagctcctccctgtctttaagctacagatctcagtctgtgggtgctacctgtccacctccccaggatccacctcgagtctgtgggtgccccccatccacctccccaggatccaccccaagtctgtgtgtgctccccgttcacctccccaggatccactccgagtctgtgggtgctccctgtccacctccccaggatccacctcgagtctgtgggtgcccccatccacctccacaggatccaccccaagtctgtgtgtgctccccgttcacctccccaggatccactccgagtctgtgggtgctccccgtccacctccccaggatccacctcgagtctgtgggtgccccccatccacctccccacgatccaccccaagtctgtgtgtgctccccatctacctccctatatgtcctgctgggcttcttacccttagaggtgctcgatagatagaagatggcaaagtgaatcaagtctcagggccaaagccaggctttttgtaagatctcaaggcacgatttaaaaccatgtgcatgagctgacagttggatgtcaggaggtcaggagtctaggtggtggtgaattttacaacagagatgataacagcccctcccactgagcccagtggatgctagatgtttccgtaagggctttctgtgtatccttagccagtgcccttcccaggcccactgggcgggcatctcattcttctgagggccgtggagtctggccatcacctaccgtgcatgccgcaccctcctgaggctttctggagtgtgctattttccacttcctgttggacagacatcttaaacatccttatgtttcccagacatctcagtctgccttcctagcataattcttcttgtaagaaatgtaggattttgtgggtggcagggggactagggaacatgcatcagagatagccgcatgctctgtcttagaggcatcatcagcctggggaacctggccagctcttgtggaccgcagtctaattggcctgctccctgcagagtgagtgggctgcttagactttgcccacttgaggcgttgcgaaataggatggtgtgtgttttatttttttttccttgttatttaagaaggaacattgaagagagccaggagggttcctagtggaaaggaaggcagggagaacagctgcacattaggattaaagggccaaggcaggacaaggccaggggagctctgagggcagctcgtgggctgtgttcgccaactgctggagatgggtgagatgcggaaaacaagcaaaatactgcaaaatggaagaaaaattgacctttcctgttatccattctcctcacagtttatcagatggtggaaggaaacactgtaattctagaaataagccccaccctgacagtgagcccccacctcccagcgtggaaataacccattcagggcagtggcaccctgctgcccacccttaggctgctataggccagtataggctggggtccctgcaagcccaggtctccttcagggcaggtgtggctcttcctctcccagatgactcagaaagccccccaggggcctgcatgggtcctgccaggtggccaacgctgaaacagaatgtgtctttgatttgggttgaatttatagccacaggtcatctgattatagtcagaaactctgaagggaagttgcagggtttttatcaataaaaaatgtttaatttaaaaaaagagattggcacataaaagcttttaatatgcagggttgcaagggcagagagaaataatgagaggtcctgggtgggtcaagggggtggacaccactgagctggggcattgagaccctgccagcaccagctgtgcccagtctgaagtttcagagattgaaggaaacttgaaattacccaccgagccctggagaaatccttgggagcccagacatttgcttatgtgcgcatgtgtgtcatgtgcatgtgtgtgtattgtgtatatatgtgtattcggtgtgttgtatgtgcatgtgtgctgtgtgtgttgtgtatggtatgtgtgttgtgcgtgcatgtgtgtgttgtgtgtatgtgtattcagtgtgttgtaggtgcatgtgtgctgtgtgtgttgtgtatggtgtgtgttgtgcgtgcatgtgtgtgttgtgtgttgtgtgcatatgtatgttgtgtgtatgtgtattcagtgtgttgtgtgtgctgtgtgtgttgtgcgtgcatgtgttatttgcatgtttgtgttgtgtgtatgtgttgtgtgtgtgttgtatggtgtgtgtgttgtgtgtgtatgtatgtatacacaggatccactctgcatctgacaagaggctgccccaagcaggagtgtcctccgatacaacaagactcgcaggaacaagtctgaggacttgacaagggacacctatgtttgggagtggtcccagaacggtatccttaatctgccccttcactgccttcaactctcattgttctcctcaatacagtgaagtccttaaaccactggtgacaccagggacgttttgtgcctgatgcccgtcaccgagaccttggagtgcagagcagggctcccctcagggcttagctcagcagagtcctcagcacaaagggcagctcaggagccagtgctcagccacagattgggaaggcttctaagccgtagtcagtgggcagtgacacggcccacgcttgcttcattaacagcctaacaagagacaggggtgagcgtgtgcccactcgcacatgcatgagagagccagggagggagtcacctcatgttatttaatcaccctccaaatattcagagctggagaccactgctgcagaccgcctcccactaaggacaagctgatgtatgtccctgagcaggagaggatgtctgtgagctggcttatttacaaatacgtgtaagtggcagttcttaatttgcaaatctgtgtctttataagacttgaagaacaaacaataatacctgcagacagaggtggataaaagcattgctcagtactgagatacattatcagtgaaggcaccctgaatgcctctggtctctgatgggtatcgctcagtaatcagccagggaggtggtcaaacaggatgggagttgcttccgatcggtgatttccccatgtgtgcttaggtttcgtcatattttttaggaatctcccttcctctgaataggaagtgcatgtaaaggcacacaatggaaccagacatagcttcctgttaggtctgtgggaggtcatggctggtgaaagggcaggatccaaacacaagcataccaggggaagaaaacccaaaaagaccccaaaggtgatcactgtgcgctttgtacaagtgctgagcttgcccgaagaaagaaagagacgcaaaagagaagcagcactgaggaagcctggctcccgggctgcttttcataaagacagagtcagtgttgctgagacacaggtggaaagtctttgtgcttgcttctttgatcagccccactcccttccaacagagcctatcaagtttgcttcctaatgagggcccccgagtgccggctgtgatgggtggaccaggctgagggagggccgggagccaggggagccactcccagctgccacccctgaggtctgggaggcaggagccccacccgtgatcccctttcccttcttttactctcccttccctgtttctcagtgcatgtcagggaagcatcagacagaacacagttctgcgtctgtccctggagcgaggccgagtcaagccctgttggggagggagaggccctgtggtcgggcaatggggccaggctcctgctggacagaggttgcttgggaggccactgaggggagaaaggagctgctgcagcacagccacactcctgggcccctggacaggacaggatgggagaggacagagcaccccagctctcagccctgctgcagttgtgcgggtgaaacggacatccccactaagggtccttggactctgtgtccagtccttgtgggtgagggggtcttccagactgtcccctaatcccacctggagcccagagaaggggccgatggggaggaaggggctgggtggctccactcacctcctttggtcgtcacttttgctgatgtttgtgatgttaaaagagatggaggggatgggcaggctagaataggtttatcttccccagtggtttctgtgtggaatggaaaaccctgagccctgcctgctgaagtgaggtgcggccccttctctgggctccaggtgggattgggggacagtctggaagaccccctcacccacaaggactggacacagagtccaaggacccttagtggggatgtccgtttcacccgcacaactgcagcagggctgagagctggggtgctctgtcctctcccatcctgtcctgtccaggggcccaggagtgtggctgcagcagctcctttctcccctcagtggcctcccaagcaacctctgtccagcaggagcctggccccattgcccgaccacagggcctctccctccccaacagggcttgactgggcctcgctccagggagaggtcccccactgaacaatttttaacttcaagatggtgcagaagcgatacacattcagtagaatctttactttgagttcctacacaatcactctatttttcactttcagggcagtgttcaataaactgcataagttatttaatactttattataaaaaaaaaaaggctttgagtctgatgatgtcgcctactataggctaatgtgcgtgttctgagcatgtttaaggtgagccaggctatgctatgaggtttgccaggttgggtgtattcaatgaatttcagacctaatgatattttcaatttatgttgggtttatcaaaatgtaaccccattataagtcaggaagcatctgtatctttttccgttttctgggggacacaaatgtctgaggaggaccttctgagccctaagacatgcccaggtgatgaggcttgaggacagctcctcccaggcacagccctttctcttgtcccgcactgtgctctgtccatggagccacgaggcacaagggccgcacgtggattttgtgctgagtggcattggaagcgtgggcatcataggcagtttccctgggggagagggaccacaggctgagattcctctccaaccttcgccctgggagcagctactgtgatagagccagattcccaagttctcattcatggtattttgaaatgacataaagggactgccaccaaacaaggcaggatagcagcagccaagatgggaaaaccttgccttccccccgggagaacagagggagcctccccacacaccgtgtaatttccagaaaacactggtgcttctccatggctctgctggccgaccacatcctcctaaccctttaagaatccagcccccctttcttctgactttaagcaccaggtagtgcttaaaagatagttgccaagccaggcgtggtggctcatgcctgtaatcccagcactttgggaggccaagtctggtggatcacttgagcccaagagttggagactagcctggccaacacggtgaaaccccatctctactaaaaataaaaaaaatagccggacatggtggcgtgtgcctagtcccagctactcaggaggctgaggcacgagatttgtttgaaccaaggaggtggaggttgcagtgaggtgagatcgtgccactgcactccagcctgggtgacagagcagccgggaggggtgaggggaactgaagatagttaccaagatacttgtgcattttaggaattgggaccaagactccagaatgttcgtgtgctcaggcatttgttcattacatcatcctcagtcccagtgtcccctcatcccctcccaggaaagcaaaacgtaactactactaataagctggttgtacagagaattcctagctgtacagaaattaatgaagccctaggaaagagaatgtgatgaaatacttaatagattgcgattgaagccactgtctgaagctgaaggaagcaggatgccgtgagcttggctgccgtggggcaggggcaccagtccctcttctctacccaaccaccctcctcccagcagtctcagcccccacctgggggtgttggaggagtgtttggattgatgatcagcaaattggggcagcatgtggcctgtcacaaggaagatctggggggtgaggatgctggttaggctggaacacctgaagcgtaaccttaaggcgagtctgtggttgcctgaggtggcaagcagccctgttggagtgccgggcatggggaggattgccattcagagtcagaaagctgcctagcgggataggcaggctcatagagtggctgtgattcctgctgtaggactggctgagggtgcctgcagctgccacagggaaggaaacatttcttcttgtttccactgcctgagctggggctctgagccactggacttaatgtggacaggagggtgagtagaacccatccattcctctgtgatcagcggtgacagcccggggcagtgtggccgtttcaggtcaaagcggacttcatcccaggaggccacgggtgcagggcatgacccagagatactgggtgctaagcagaggtatgacataggtgtcttggccccgtatctgggccacgcaggtggtgtctggagcatcctttggagaccgttcctggactgttactcctcttatgtagattgacctttctctagctggggatgttgggccaggcatacctgcccatggaaaaccaaaactgttacagacagaagtcacagtgacagagcgttggtaggatggagtggccagggaacctgtgagaggagcctgtaccgacactgcctgcctcacacagcatcaggagggagacaccagcggggccctccatggctaagtgggttctgcttctgaattgcaatttcttttatatgtttattccattttctgggtcacccctcattgaacatttactatgtgcctggtgatgtcctgagtatacattagtctaaggcggagtcagtgttgatccattccaccccagctcaagcacccagccagcgaacggggcgaagtgcaggcagagagccagaagcagtgagggtgtgtgcttggcttcctggagtatttgctaatgagcaaaacaaggtttgccggcttgaaatggaaaagcaacagggaaccaggaatgaattgctccagaaaagccctggccctgcacccaggagtctcctaccttgtttggtgtgaaatctgtaaacatctccttcctcagagacacagctcctcccaggaggaacctagagggatgtgcaaagaaaatctcaacccaaaagctcaaaactgtagagtaaaaacatttcacatttggcttttggagtaagagtttttcaacaatggatacagaccatattgctgttcactttcccgtaaatcaacgtgagactttgctgtcagccaacatgacagcagtgaacagagcccagggaacccctcaaactcaagatagtcaagttgtaactatggcatcccagccaggaccttctggagtggggaccaacaatggggtgaggccccgtgtggttcccaggatgccagaagccccatatccagatacgtggtgggtgctgcattgtcatttaggacgaagggcccccctctgccaattcactgcctgtttgcacagaaagtcgtgtgtcctcagtattggacttttgtggtatcagtattgaggcccacaatgtatctgactatctttaaaatgctgtacaaatctgaattgaatataagtatcctataactggagtattgaatgcggctagaatcatcccaaggcagaattgagattctaaccgctacgcacacacactcacagccctggatcctcctttgtgtgtgttctttcaacatggtgatggataattttcagaatggggtctttgggtacatctggtatgggtgaaccatatcttgacactgagtgacattggggtgctgccctgtcccatccctgtgtcatggccgggcctcctgcccccaccactcagggcagcccgtctgcctctggccagctgtcggagctggacttatccctccctggtctgaggaataagatgtacccttgggtcagaaccccccacagccctctgcaatgactgtctgacagcctttttcctagtaagctgcttcttgcttgtctaggtgaaatctctagcaattgcccaaccaaaaactgggtcttggagctgatggctacacatcccctgagggtacctctgaaaagcaagaccttttgaaggatggaaccctgaagagctggtgcagaagcaggactgtgcaggcaccatgagggcaagcacgaagccagctgtctgcacagacccaccagcatcccgcagctccacactgctttcctggtgtgtgggacgcagggagcccccttcgcctctaactgtgtgctgcactcacaggggccgagtagggtgtgtttcttttggtgatgatgtctacttgggctgaaggctcagagcgctcgttcctttggagaccctgctgcaggcgagtggtgagcacatgcttccgcacagacacagctgccaacggtcctcctccacaccagcgctgagttgtcatggagacaatacaggctgggctgtgtgtggtcagcagaggggcactggcccagctgggtgggtatgtgagaggatttatgaaccagcatcaatgcatctcagttaaacagcccccggtactgccgcacacgcaggacgtcaggcttggtgtgtgtgggttcccggactggtgttctgtcggcaaacgttctctaacatccctgacccggttcccttgtcatgccaagacagtttcctagcagccttaatcatgaaaggaatcacaaaggacccgtattttttccctattaagctactggaagaaattaaaacagggaaagaaaatggttacctttaaaaagttggttttaattttaccagtgggagaaagaccagtagtcaaatagaagttgtttactgagtatttcgggttgaagagatactggttcttgatgaccatctggatgatttaggatgaattttaaaatccgctgtacaggaaattaaggcagtgctcattaactaggaagatcctaggcctgtcctgagaataattgcacagtcgtctgttcagtgctgcctgccaggctgggaaggcacatgtgtttctgtggatgtatctgtggggcactcagggccctggaggcagagtcttcctgagcttgtctggaaggagtgcttcccttggtcatcccaagctccattgagccttaacgcatggatgaggggggaggcaggtctccaaggggaccctgagacccatgcctgcccccaggaggtgtgcggggctgggcggaggaggggagaagggagaactgagagcctgcagcatgtgccagtggaggaccaggtgaatgcagaccccactcactgggcacgtgtttagtgaatgcatgtgaggtgccaggtgtcttgtacagatggggagttttgtggtgggacaggcttagagtcctcctctgctagagcttatggcttcatatgatgatagacattaaacatgcgcaactgctgatggggacacacgttgtcagggacgcatgagatctatcacgttgcagggtaggagtcacatttagaaggtcatagatgtccctttcatatggtgacagggtatgcaggttgtgactgaaatccagatatgctgcttgagaccaggctcagcatacatgctgattgcttataaaggggttgcttgaagtgaaaggaaacaagtaggctgctagatgaagaatatgggctctggtgtggtaggactgggtttggtgcttgctttagggctatgtgactttctgtatggaaaatggaatactaattatgctggcaaggataatacttaccatagttctgggcttataaaagagtgccagtaatattacctcctatgtgtgattattattaacattactgctattttattatctttattgtcatgtcaaggaaaatcatttgtggtagtatgtcaaaggcaacttgtagttctggaaatcttctaggatctggatttcttagaaagttaaaaagtcattattccttggaacaaacattatggagatttgagatttcaagttcattggtcctaaacatgttatcattttttttgtatatcaaaagtgaattcctaggtgtgtgcccaaaagaattaaaaaacaggtggtcaaacaagtatacaaatgttcatagcagccctatttacacagtagcgaaaaggtgggaccagcccaagtgtctatcagtggatgagtggataaacaaaatgtggcctgtgcctgcaatggacttttattcagccatcaaaggaaatgaaattgtcatatatgctgcatcttgtgtgaacctcaaaaacattatgctcaaaaaaagccagccacaaaaggtcacatattgtatgatttcattggtatgaagtatccagaataggtaaatccatggaaacagaaagcagattggtggttgccatgggctgagaagaggcggcaatggagcagaattacttcacgggggtagggctttattttggggtgatacaaatgttctgatagatagaggtcgtggctgcataacattgtgaatgtagtaaatgccattaaattgttcactttaaaatggttaatttcatgttatatgaattttgcatcaataaaagagctagttctaagcaccatttatactgtaatatttgtagattaccataatgtaaaattgtccccaccatataaaaatgttctagatagaggtagtggctgcacaacattgtgaatgtagtaaatgccattgaattgttcactttaaaatggttaatttcctgttatatgaattttgcatcaataaaagagctagttctaagcaccatttatactgtaatatttatagattaccataatgtaaaattgtccccttagaacatctcagaacagcttccaccattaaaaaaaaagaaaatgtgttccacgcttgtctgccttattatcaccacagcaagagcctgaggttgacctttcatgaagctttgcacaatcatcatgaaatgtggtttctcgtactttgctgcatacagtgaggccccgcagaggctgccacgtgagactgatattcaccctaccctctcttgtgatccagagaagtaggagagcctagaggcacaccaggggaaatcagatcaccaggcttcagtttatatttgtgataacgttgataagttgctcagagccctgcctgttggttagtgtgatgtggcctgaggagggttccgtgaccctccattcagttggaccgacaccggaagtctgctgtaggccaaggcagcagcttaatcagggccttatttattgattctgggttgtagattgttcccgatgacctagttgactagaaagcgtcacaggaaatgtgcaagttggctgatgagcactcaaaagagtgccccgcacccgccgtgcttctgcccttttcctgccctgcctggggaacggttgcacttccaagttcaaggattagctgaggttgtctggatgcttgattagcgcgtccttttaaaaggttcattcctcatctcgctgtttgccgggtacccttcctctcccggacagccgcacctgcttccctgtgctaatgacagtttatgaagcgaggcacagtgagagggatctgaagcgttcgcggggagctggtaataggatctaggattttcccttcaaggtcggttggttttttgagtccactctaggtttatggagaggaaaattcattataatctgacattatttggctatgaccatggaatggatttatagcccacgtcatgtgcagctgggtgaggggagacgaacatgcccccatttggtctccaatcctggagaggatttcatggttcagttggcagagaggaacccagcaacccttcattcaggaggcagtgctcttcccaggaagggggatctcggacccagtgatggtagaaggcattctttggctgaacccacgagggttcgagttaggagcaggcattcaacttaagacctgagaaaacaccagcgttctcccacatcaccatatgtgtgagtctgaacgtccctggaggtggcatacgctcatgtcttagaagaagaaaaagttatttgctctagaaaagggtcacgattagatggatatgggatttgtcctttgagctaggaatggcattgatggcaaatatgtgtcccgtagtagatgtagcagctgtcactgggtgatggcctgagagtgactgtcagtccaggcccgtctgaaggctgtgactgtcctccgggacccagggagggcaagaagctttagcccaggtgtcgctgcatggaaggccttgttcaagccacttagtgatgtattttctcacctggaaagtagatgtaatagtaactggagaaaacttgtgtttcatttgtatattgtgaaactaaatggcatgcttattattgttttgccatggtgctttgggctaaggcgctggacaaatctgaactgttaccagacaaatattctaagtcagatagagaccctttttggcttgttttaaatcacattattccagcttttgtgatacctcagccttctctgttgttttgtttctagagaaaacagttttgacttacatatatatatactacctttttcctaaaaggatctaaggggccttatacaaacaatatagttaagcaagataaaataatctaaattcacatggaaaaaaaaatgagattaagagagtagagatgaccaaggttcatgtttcggggagggtgtaagaaggggagtcctgagctgggggactcggcttctccctgaaaggagcagtgggcaaatggacagaatcaacagacttccctcgagcacctgtcaaatggcaggcaccatgctctgtgctgggataaagctgaagtcagccccacgccggcggtccctcaactgtccagagccctcaggactgtaggagggggcatggggtggcaggtcagccttctgtatcttcattacgtagttagaaacagttcccagaatttcagtcgcatctgtgcctggtgtgccctgcatttcggatgtgtcacacttggcctctccctcactgtacaggaacctggatgtgactctggaatcaggatcactgaggtttgcagatgatggtttgattggattttgaaatgattattttctcagtgtcatttcatttactgctctttatgtgaccccggcctcggtgatggaaatcaactttgtgttctcaattactacgactgtataatttcataagatttagtatctcccgtgaagagtcctacttctgctaggacattgggcagctgctgcatctccgagcagtccgtggaataccaagtgacaggcgctggtccgttgaaagtgcctccctgagacttacgtgtacactgtcgttatctatcaccctgcactcctccgcgtgcgtagctcagaactgactctgaattaaacaggcagtgcttgggtttggatgtcctctcccactcagggtgcctcccattcatgaggagccccaggtgtattgtgacaacaagatcattaccacaagcgtggctgtgggtggatgtgtaggttttgggaaatgattacttggaaaattaagttcttatacctggcagtcttacctcttaaaagtggagaaacagtggccaggtagactttgctgtgaattacaagggcatttcttctgctgaaaggcatttcaggccgggtgtggtggctcacgcctataatcccaacattttgggaggctgaggtgagaggatcagttgaggccaggagttagagatcagcctgggcaacaaggagaccctgtctctaacaaaaaaaaaaaaaaaaaaaagccaggcatagtgtcatgcacctatagtcccagctactcagaaggctgaggtgggaggatggcttgagcccaggaggtctaggctgcagtgagccatgattgtgccactgcagtccagcctgagtgatagagcaagacccaatcttaaaaaaaaaaaaatcaatttcagtaattcaccaggactattttctctgcactcctttgtggaggatgtttccctgagcccacggtaggcactttatcggcagggccccgtgcttcagccaccctggtgcacacatagcagcaggctggtgcccgtaatgggggtgggcccaggggcatcccagtggggcttgccagtctgcagtggtgatgacacttctgaaggaatgggataatttcatctaacttggtgttcagtgttgtctgttcagctaaaataaatgtgcccgatgaacaaagactcatggttgatgatgaggcacaaggattcagcagaagggacagccaaccctggggttactggaatgtcgggccccaatgtcactgcatagcaatgtatcccaggagtcagcggcatataggataagcacctgctattcacagtcacttgtgaacatctgcctggcttggcttcaagctttgattaggtccaggtctgctgaattttaccttctttggaccagcagcttccagagccatgtcttcatggtgaaaggcaagtccctagggatgcaagcccatctgtacccaactgaaacccatgttacccttcacctgtatcttgtttgtgggtattgcatcggccaaggcaaatcgtggggctaagcccagggtcaagtgtggggacgtgcactctgcagaagtggagggtggggatgagtgtttgctgggcagtagtacacccgaggctccgtgagaatgtctactttgagcagtcaagagaagacacagattttagacttgtaggtttcctcattccaaagttggtgtgcttgtacttgattttgaagttatctttcttccagggtgatgggggagcatgaaagtaagaggatcttgggaactgctgtgcccattaattttatggcaaatccacgtatcacctggaaaaccatccatgggatattgagtagtggaccaagagctgtggtccggattccatgcatacgttttgggaagaggctgacatgaagcgtgctattagcttgtcgagagccctgctgacttctgaatgtggcttagctcctgccacgtcctttgttcttccaaggttaactgctgcaaagggattgcagtggccagtggagggctagtgaaggttcaagcacactgacaattaggctaaatcggcagtggcaggttcttgcatggaagttgcatcacctgctggagtgactgtcccttgacctcctcctgtctactgggtcttcctccacctcactttaatgctgctatgctgctaatgtgaactctgaggctttaactggggaagtcgccaccgccccctccatcacccttgtcctacaggtcagggctggaatgaggagcacttgcagttgcctagtgggtgggatttcaaggaaacgggatacctttcttccccaccccttcaccttttcccagaaatggtctcatcactgtttccttttggaattctgtcattggaatttcctgcttttgcagctcttgccagcttgcgtttcttttgaaattcagtacgcttgggagcagtgacgcgaaacttcgcagacgctgacctcgctgacagagccaggccgggcaagaagaggtccgggaggatctatcaggagtgtgggggctggtggggcctgccctgtagcgaggcttagggtatgggcccctggggggtgagagaggacaagggatgagagttgggaggtaattggggggcggtaagaggtggagggtgaggggtgagagggccccaaaaacacaccccctgggccacggtttctcttaggctgtgctgccccagggtgggagtagaggagattctggacttcagaatgccagccaggctcccctcctatttttttcgatcccagagacaacagagttctttttttctgcatgttttttgggggctcctcttttcttgctgcaatgctgtcagaatcataaagagctgacatctataattaatgtcagtggcctgcactagtgaatgcccgtggcacacagaacacctggctgtggagaagcagcagcaggacctagcgtgttggcactggaaggaaacgcagaggcctttcccctcattttacatgcaaggaaactgaggcccagagagggggccccacagccagccagtggcagtgggctctgaggggctctggacagcagcatcccacctgagtgcgctcttggctaggcagggtgatggggccccagtctggtggacgctcagcaataggaaggggagcggtggggaatcccttctcgttcccgggtgctggtctaccagactggggctccactggggccatggtccaataccagtcctagcagtcattgaaatatggggtttcaggctcctgatccttaaaaaccctgtgtaagtagtctccaagctaaaaacaatctacactaatagatctgctcatcaaaagattattttgagagcattcgggtaatgtaaacaacctttctgctttgtagcacccagcagtgagtatctggagacgttggaaatggggctcacccgatgagggctgtgagcatgagcctcgagggcgctgcagggttcatctcatttctctcttcatttattgagcacctgctggataacagtggtcggctgttttatgtccgttgcacattattgcataccgtgtctaataagcctgcagaagtgggtgcattatcctcactgcaaatgtggaaactaaagcttggtactaggaacttgcatcaggttccctaggtggcagtggtgatgcagaacacacacagatctgcagaccttaaagcctcacgctcctgacaactgagccatgctgtccccagagccgaccttgtatgccatgacagggccagagagagaggactggttacttactgcacaccctgagagacaggaatgggcacagttgtcacctatgccataggaaatggagtgccacctgcacaatgcagtgagtcacggttctccctgtccctcctgcgaccccagcttctgccctgggctgctggagggcacacttaggggcacaaacacacctgacaacaggttgtgggttttgttggggtggagcaccctcagacccctcttgcctcttccttccccgggccccctccgttatccatcaggaattctactcttgggacttggaaagtgaggagagggaaggactagctctgccgatgtgacagtctcagagcaggatgtccctctagtgtcctgcatccagcacacgcacagcacgtgtactggaggcagctcttctggttctgactctgtgggtgcctttcacctgctggtcctcagcagagcatgcaaagggatgagggagggtgattcactgtgggagagttaaggatgggagcctctgggatcgagctccaggtctgctgtttggtaaagtgctttacttaatttgagtataagtgtttagagtgagcagctgctgaattccccacagttcttagattcagggtagaggaaatcagaagagtccgtatctgatttccatgatggtggagtgggtgcaggcccagagagcaagagcaagcctgcacagaggttctgtgccaatggacacactgactgtcgggggcacgctgaccatgggagggtgttggggagcacacagacccccagcgggctagagctgacggttcccactgagagggaggcagaatgtagagatggccatgtggcaggagctgaaaggcctgcctggctctgtggtttgtagagcagaagcccaatggccgagcgctgggccaggctttcgggatgctccagggctcaggttcaagatgctacatctctgcttggtgtcagaggggatgctggtgggatatgagtgggggctgcatggcgaagcctgtctctagttgcattctggctcagggaaggtgggcttgcttcctccctaaggagcagtttctgattgatgatggatagcagctatttttctttttatcttgttgccatgagtgtttattggggttaaacctgcatctttcctttacacattaatgtagggagatattggctttgagaaatgagtgtagatcagattgactgtttagtctaacgtgttcataattggtgcaagttgtctgcattttcttaaccaaaaaaatctaccccaggggaaaagtggactctggttttgctgagataccaaaacatgggtgtgaagtaactgggagaagctctaggaatcttctggtcctgctccaccactgccaggtcatgagcactgcaggaaggcccgagggtcaccaagacgccggcctgccctgcggtgggaggacaggggaggggtggtactgccctgtgcctcagctgactgcagggcctgggaacactggccaggagaacggcgcacagagccaatgcacgcactccacctctcgcctccgtggtgggagacgtccgggcacccttgtttgcttggagcacttcacttaaagtgggtctggctggtcattttcttgcacttaccagctttatggctttgtttcatagtttagtcctcagaacggccaaaggagaaagctgcagaagagctcaccaggaggtagaccatgtctgtgtcctccagggctggcaggcaggaggaggtggaggggtaatggtcctcctgtgaggagaggagctatggatggggagtctgatggcccctgtagactcaggtgacagtgagaaggagaaactcagtgtaccaatggtggcattggggctggcttgttactctccctgggtcctactccctcacgtggaggaaggggtgactgcttggcatgggttggcaaggactgtgtgaactgtgtatgcagacagaaggtaagtccaggcttggccagggccagagtcatgggcagcagcggtgatgatggcagatgatcaatcctgaaaggtaataaaaatgcccagggtacagcccagaaatgcctgtgatagtcccagaggtgcctggagcatgcctctgttcgctccctccaggccccagcctggcagtctcccgctctgggtgcttgggccatggccacagccttccccctacttaaggcctctgttcccactccccacttgtgggcctgctggacacctgctcccctgctccttccttgccaccccattgccagcctctgccaggcctcacctcactgcgttgaaattgagtgttttggtggccagtattgagctcacagagggagtggagctttgctcccctgtggaggagcactcagaaatgctggtgaccacagagacccctggtgttgtccacaaaggtctccagaagagagtaggggagggatgggccacccagggccgaggtaagatcctggtgagcaggatgggggcacacttcagccccttcctaaaagctggggctgagggagagcgctgcagggagctgtactgtactgtgattcagtgcacatggggacctggaagcaggggacagtagcccccttttgtggtcagaaaatttgagaattggggatgctaaatcgctggcctgagccacagaggtgctacgtgctggatttgggatttgaacttggctctctgcctggctccttgtgtttgttctctctgctccctgggaggatttgccagtcttgctgctgagccactggggatgctggggagtgagtattctatatgcatcagctggtgaagcgcttatcaaatgacccccagattccatctcacttggggaggccgtgtttccgcctccctcctgtccccacacctctgcccgtgggtgtttttccaggagagcttgccctgggtaggaaagccgaggggagggtggcattgggctgccttctcacttgctgtcacctcccttgtcctgccccctggccttcccagatccaccgtaatgaaagaccttgaacgaacacatccctcaggtactcagcccagggtcttacagaggggcggtcccaggggaagggggttggggcctgcagttttctcaagtgtggtgtgaccctcaggaatttctttttggtgatcttgtcattttggtgggtgttcatttccttgagcatcttcactgtattagtagccatgagtattactgaaaggcatttttattcttaaagcattcagggactgatagcaaccaaaattatcagacaagctgcaggagatgaaatcaatggaatttggcaattgtggggcaggaccttattcccaaaggtggctggtctagggcgtgtggactgggaggcaggcatgcagaaggggacacacccctcccatcactctcctctcgtccagccttggaagccactggagtcacatctgctgcaggaaaccctgtgtttgaattatgtgtggagcagtcacagggtggttttggctggatgaagggcatagagtggcatctagaagtgcatgggagaccattgccaatgtcatgggttagaccatgtttttgaggctttagtgatttttttgagacccttcccagtctaggccaggcagatcatcttctgtgcacacctctgcaggtgaagtccccgcatggctaagcacatgtgtgtggagtgtgtgtgcttaaggatgtgtggcctcgtgtcagatgacatgtgtgtggggtgtgtgtgtttaaggatgtgtggcttcatgtaggttgatgctcttgaacgtgctgactttaaaaaatccacactgggctcgtctgcttccctgatgacagagtttgggaaactaatgaaagacattctggccttgtgccatcagaagtgaagtcaatgtggggaacagctgcctctgggaggacgttgtctgtgcgctgtgccgcggggcctctgctccatggccggccacacagccctgtcctggaagaggcccaggcagctgtcaccccttagcccagtctggaaagagcccagggtctggagtaggggtgacagtgaggctttctatggaagctgctttaaagaaggaacaaattgagcctggcactggccttctggttttggagactgagttgccctgccctgtgcttgcagatccactcagtgtgaagggcaggacagcttcccctttccacacctcctcataacctcctgggaagctgctgaaatacaggtgttcatggtggggttaagccagcttgtgagtcattagcatgcctttccacggccaacgcacaaaacttttgtcttaattagacttgaggcacaaaccgctgattctccagtgcagtgtgcctgctgtgccgtgcgtttttgttagtgtgtctggacgtggtattcatatattaacagtgcatgctggggcacttggactgcagggcaatcgcttgcctggcggtgggagcccagaggctgaggtggtgcgtcatgttctggccacggtcaagccccggagtgtgtctgtgctctgtggggagcctaacctgtcatctgtgtcagtcctctctgagtgtcctatggggaaaagttcacttggggctcatgaaagcttgcttttgcatctgtccctgagcctggtccagtgtgagcaagctgatgccttgtggaacctggatccagacctggcagggtgtgagtctgtgtgttagagagcatcctccttccagtcctggccttgttggcttcactgcctctgcgtggctccaagcctgaccactcccttcctcccatgcccccagcgtgcctccttctactgcattcagatttttgtccactcacccggttttcctcttttctgccctgggttctgagggtccatggcctgcaggacagtttgcctaggataagccaggacacatcagaggctggtggaagcctgatctgctgcttagaatcaatggtgtttctgacatggagaggtggacattcaggtgcctatcattacatggcagtaggaaggtgcttggaccctgcaggcctggtgctttgtacctgtggattttccaagtcactttattcaaggatttcatttcactttcagttcttaaagtaagggcctggcaaagggataggcagcattctgtttctctgagggaggtaatgctctgccatcagcagatttccttatgatgatggaaaagtgtggtcaagggatgtgtttgaccctcctgtaagaagaatgaaggtgtgctgcccacgcagtggtcactccagggggcccttggttgcaattcaaaggcaagcaggaacctggaggcccagaggggcaaagggcatggggctcaggtcctgtggtcactcagcacatgctctctcagctgcaccacagtcccgcacaaggccatctatgcttatcacctgggtgcagaagaccaagtcactaaaaccccagagccaggggtttgctccaggtgggcctggactttcagctaaggccccttctggattggcacatggtgaggggagcttccacacccatgattctaaatcccaggagctctgaagcaggaatcttttccccctgtttggcatagctcatctgctagcaaaacctgctttgagctaccaggattcccagtacctttgggagtgttgggtttccctacagagatgtggtgcagagtggacgctgccccatacctcccgggaggagtgacatctcacagggccagtagccattctacctttcccagatccaaacttctccaactctaaattcgttgaccggtctgtccccagagaaagcagtcaatgctgtgagtctgcatctgaaaagacagtgagcatttgtggaccctgcccaggtggttccgccatcctccacagactggcagcactgaaatgggacgtgcaactgtccctgtgctcagctctgcactgctcttccctctcagcaactttctgatttgcatccatgcttgctctccatgtttctgtgatctcatctgtgacatacagatgacagccatggtattggcctcatggggggttgtccagagataaaaaagacccagtgattatatgccacagaattttgcatccaaaatttgcattttaaatttttccaagggacttttttctgctcgggtctagcgaatggccccttggtctctcctgtgtagtgttttgtggtcacaataaccctggattcctgatgccctggtggagaggcgataccagtgtctgcagaccataagaaagtacatcttgactctgaaccacagctataaataaattgacatgtttatctgtgggcttacagtgacatataaaatcttttcttgaggtgcttaggtatctctaggctacctgagatacctaagagagatacctcccttctgagagcaccaggttgggacactacgctcaggtgacttccatgcaccctgcagagccaccctcccccttgaccctgttggtgctggagactgcatcatctgcactatatacccaggcgcaggtggttggatttgtccaatgggaggcgggaggggaactgtgagatcagggtgttccccttctgggccctccctcggatcctatcagaggcctcagatctcatcagaggccctctgcacagagctcttctctgtggcctctgcagagctttttggcccttccctttcaggcctcagatattaaagcttcgcactgttgccagttttagggcgctgcactctcctgtgtgcagtttcctaaaccccactcatagtcctatagtttttcttttgctaactccccttagtgacccaattaagtgtgccacctctctacatccaggacctgcctgttcaaataagcaagccagagaaaggttcaagttcttatttgaaaggcgaagtgagccctggcatgggccatcccatggccttttggctgactgccaccagcaggttgagctgtcccattgtcacatcactagccttaatatagtctcatgccctgaagttgtcttgtttgcccacaagacaaggctatcaggaaaatgctgtgaaccttggtttccaagaagaactcaaacttagatgcgatgtgtttgcagccattcagaataggtgcaaggatccaaatccctgggcctcaagaacaaagaaagttaaaaaccgagaagactgtcattaactgtaattgcttttgcataactcctttcagagttattgcaggcatggagtccggggagttgcccatagttcttaatgtattagggaacaggaacactcagaggtattctcatctaaagaccagttcacaaaggaggcatttgaatgtggatatgccagctttaaaacccgataaagccagaaagtatgagagcccacagagatgtcattaaggaaattatttcctcccaaaatagaggcaccccaggtgacctctcaaaacagaatttttgtcatgttggtctggagtcacctccatttcctttctgttgagaattgttctgtttcctgacagcacactgggatttttgcaaggcaagtcattgtcacccaaggagactgacttcttttcactcaattacgtttttttctctttgccgggagcctgggagattgctggacctgacccctgtcttaggaacatgggtaaaagttgtcatgatggaagacacatggctgggacagcagatggctagaaagctactacaggaggactcaaatcactttcttatttagtagcttctggaaatctttatgcccatgtggtagaaaaacagatgggtgttccgtaaagaaagcggcaccagtgtctgcagagcataagagattgcatcttgactccaacccatagctatgaataaattgacaaatttatttgtgggcttatcaaggacataaaaaatcattctggctggcaaatgaaaatggcattgtgttgctcactaacattcgtttgtcaactgttcctggaataggtgctaaattataactgaggagctggcgttataaagctgaactggattttccaagctgtcatatgaaaagaaaattattaactatctcctcctccatcccctgtctctctctctctgcagaaaaagcccctttctctgctgtcatatgacttggactgcacgctctatgtgcacacggtgtaatgaatgccacattatcacccactggctggggtgagccttcttgttatttatttccaactggaacaggatttcacatcccatgctcccacacaaaggtcttagaaacaaccatttcagacagttccttgcatcagagttttagggtactcttctgcacacaaactgttgttggaacatgagcttggatttcttgatgctacatgtcacggattggcaggaaatggtctgggtggtgctgctcttatacgcactcttggtcagacattgtgtgtggtggaaatctgtgtaaggatcttagcaattatggggaccatggtgtagcactgggatatcttacttttcacttagatgtctctgcttttggttttgagacatcacgtggaaagctatgttggttttcatcctattccatggctctctggtgttggcaggctgcacttcatagcatagaagatgaaacatgatatgacttcaggaacgcatgctgagggaagatgtgttgtcatgaaaatacacttttttttttaagctggaaactgggtgacagtgaaatcttaaaaactggggaaatcgggaaatcaactaactttctcagatcttggtttcctcatattgtgtatcgcattgcgggtttgaaccagaggattgctgaggttccttccagctctgcttctagttcttaaatccaaagcctatggggctcttggagtagctcaaggcttctgatctttaagttgcaaacagaccactggggggaccttgttaaaatgcagattccgattctataggtacagggggatgcctggaattcaggattaaccaaggaatctctcttgtgatgccaatgctgctggtccgtggaccacactttgattaccacagatatagatgaccaaagttgcatggtcctggatgagccagatcccttctttgtccgggtggcttaggtctgggtggctctttcatatcttcagacacatcacatcattccttctctttgtcagtaaagacagacaaggaaaatgaagtgagaacttctctttctagtaatataacacattgcccccaggcacgtaatacatacttattagagtaaatgagtgataagagaaattagtgtgatcagggatgaatgtaccataaatactcaaagtcccttcaacctgccacacacgaacacacacatatatgcatgcaccagatttcattacccggaatcctcatgttcgtattctatagcgcccaacttctattttcctcactgtctcctacacatattatgcctagctaggctatgtcctctgactatcctttggcccgcccaatgcctatcattttctagatcaatgcaagtcctaagtcttcttgaagcctctggattcctccaactcagacgccctccctccctgttgtatccatggtctttgggagcaaggatgcagacccagacctgactgctgcacctgcccagctgcactcaagggaggtgctgctgttacacccatacctttcctgggctcaggactgggcttcagagcctttacaacacagcactcttgatggcttctaacaactgcctgaaacatcttttccatccctgatttaaggcttaaatattatttttattcttcatgtatatattctcttcctgttttgccagatggtaaattcgttgagaatagctgctttttactgttttcctggggtgcccggcaatatgccgggtacatagtaggtgcacattaaatgatgagctgactgcctggagcagcactgagtcatacattctcatgtgctggggtaatgcttaacacaacaaataatcccatagcttccttgaccccaaaggtgtccagaaccagtcacttaacagctgaaatggaccctgatttggggcacttgtctcatgaacgtggggagagtgagagggcaccatctcacatgattcctttgaaaatgctgtcaggatattatggagaaatgccagaaagcaacaacagaaggctgttgggagaaaaagaaacagagtaatctctttttttttttttttttgcattatgcttgaaggaggttgtttgctcttcagtgttctacatgcagctgcctctattgcttttggttggaccaggcccatctgcccaaacagtgagtggggattatgcatctcagttcctgcaatctcgcctggctgccgtgcaggagtcagatggtagggccaggaggaccgggctcagggccaggggccttcgggcacgtgctgcggaggagcgcttgtgagatgcacatgccatgtctgcagccggcgatgcccttggaagaagctcctgccactgtccctgtgatctgctgagcccaggcagctcctcgtggtggggaaatgtgtggaggaattttggaagactggatattgttccagtggggtgtgagatcctctggccttaagtcgctcctctttgctcctctttgtctcccaagccaggcttatccgcaggtttcaaagtggggaacctgaacttggtaaggtctccagtttcaggtgactgttgtgtctcagctctgtcaaggagcagctccaaactgagccatatttcatgccttctcagtctaaagataatatacttttttgtttgtttgtttgagatggagtctcgctctgttgccaggctggagtgcagtggcacaatctcggctcaccacaagccctgcctctcaagttcacgccattcttatgcctcagcctctcgagtagctgggactacaggcgcacgccaccacgcccagctaattttttgtatttttagtagagatgaggtttcaccgtgttagccaggatggtctcgatctcctgacctcgtgatctgcccgcctcagcctcccaaagtgctgggattacaggcgtgagctaccgtgcctggccccaatatgtatttttaaatgtttctttctaattaaaagcatcatttatgttctctacagaaaatttgtaatgtataaatgtataaacataatatttttaaataggaaataaaagttgcccttttcagaatccagagagtccccttgttagtgtattggggttccacatatgtgtttgtttttcaaacatggctgggatcatataaacatgaagttttgtatcctggtcttttcacttaatgctatgtttaattggaatattttcactacactaaaatgttctcaaaataggatatttcatagctgtggaagaaatcattgcgcatatttcccatgatttctgtaactgttcacctatccgacgtttagcttgttccagtttttctctactttaaatgacatcatcccctagtttcacattgcattccctgatttctattttgggcatttttctttcctcttgccaattttctatctatagactctgcctagaaaagcgtctttttgggatggtgctgagaggagcacaaaccggcctggtccatgtaacagcaatttgacatgtatttattcattttttatttttttgagatggagtttcactcttgttgcccaggctggagtgcagtggcatgatcttggctcactgcaacctctgcctcccaggttaaagcgattctcttgcctcagcctccccagtagttgggattacaggtgtgcaccagcatgcctggctaattttgtatttttagtagagacagggtttcaccatgttggtcaggctggtctcgaactcctgacttcaggtgatccacccatctcagcctcccaaagttctgggattacaggcgtgaggcaccgcaccccaatttgacatttaaatggcatctgtcagctgcagttcagggagggtccctgcacaagcaggaaggactgtctcgccatgacactgcaggggacacactagaaggaatgggacacagggacagagctccgcaggcagtgccctgggcctccgatggtgctgtgtggggccctgcagacagactcaactgccttagggcacccgtaggagggaggacagagggatggtggagggaaagccttctgctaaaaatacccagcactgcactgcgaaggagtttggatgacaacttgtaggacacagaagtgtccatttgtgtgtcatcaggggccagaaaaatctgggaaaggggctgcagccctgttctcttgtctggactgatctggacattgagtccctgatgtcccaggctaccccagtggtgaccgggctgcctgccctaccctgcccccttctctctccactgccagtggtgggtcagcccccatgtcaggcagtcatcctctgtcccctgcatgcactgaccactagaaaacaaagggtgtgaagcccatgccaacctgggaagcctcttcctgaaagtaagtcaagtttccaagactccttcatttgtctttgggcagggccctctcaaagtggggatgagttacatcggaaagtgagtgtcctgtcctagcaatgttcatgttggctgtcagccttccctgaatcacctgctcaaagccatgtgaacagggtgcaccctctcccagctgtaggtgaacgctggggttttgttacagatcaggagtcgggaatgctgggagccgcagcccaggtgtcttgctcctctacctcacatttccctcctgtgaaacagcctgaggcttgttgccgagtagccctgactctttaccaatggccggcgccctcctctatgttctccaagagcttccctgggtgggggtctagcatccagggggcagtgcttggccgagcagctggttgtgtcacatcccttcttggaatggtcttttctctgcctggaaagtgacctggattcttccttctgacatgtaagatggagctctgttgtggtttatgattgctccttgggcccctccatgtaatcagtttactctgcccgaaagtctttcttccactgtttcaaaggaggaatttgtatgtcacatacagctccttggtgggggattttgctggagacatggggagctgctctgaagacagtgtcctgcctgtataaagaattgctgtgccgtgtgcggtggtcatgcctgtaatcccagcactttgtgcagccaaggctggtggatcgcttgagtccaggagctcgagaccagcttggtcaacatggtgaaacctcatctctactaaaaatacaaaaattagccgggcatggtggtgggtgcctatagtcccagctactcaggaggctgaggcacaagaatcacctgaacccaggaggtggaggttgcagtgagccaagatcacaccactacactccagcttgtgtgatagagggagactcagtctcaaaaaaaaaaaattaattaaaaaaaaggtaaaaaaaaaaaaaagaattgctgtgagagccatccttgcattcttccatctgatcatcataggcttgagcaccctgctgggtgatgtggtgacggggctgggctcagctgggaggaagacagacacagccctacaggggaagctagggccacacccaagaaaggggcagtcacgacccgagtgggaggatggctccaagtgaggaggtaccgactcagcccaggcttagccaagcctctgccccagagctgggcatcttggggtgcacagaggaggtgctgcatgagtgagaaagacttagtgaggagagaagcagggagggaaggaagtgggtggcagtggaaacagcactttcccagttgttctttcagccgatgttcattcagggctcatggtagccaggccttttccaagctattccatggattagccatcgctatgaattctcaggatccctgcaggaaatgccactgttgtccatgtcacagatgagaaaattgagatgcagacttagagtatctcatccagtggcatgcaagtggtgtggtacggagcacccacgcctggcctgcaggtgcctgcccctctccacccctgtccagtgatgagcgagctcatggcaggcatgcaggcaccctgggctcctttgcacacactccctcgcttgggcctgcggtggctccaggaagcaggtgctcttgtcatccccaatttgtagatgaggaaaccacaggtcagagaggttaaacaattgctcaagtcacacagctggtgagcaccagccaggctgtaacccaggccgcctggctctgaagtcttcagtgtctaaagaactcagggcgggagccgaggggcacgcagggcagggagaggaccctgggaggtgaggctgggaaaggaagcagggctggaccctaacagctttgtccttcttgtgaagaagggggcttcatgttgagagaaggaggtctcactgtggagggccaggtggtgatcccagccacatgcttgtagccacctgcaagtgcccaggcatgctgcagactcactgcagccccacaggacaggggcctgctgcctggttggtgtcaggaggccggcatttggggacatgaagatcagggagggggaggtttacctggggaggttcacctgaatctcccatggttgtgagatcttgtgggcacgtctgtggtggactctggccggctttacggatggctgcaattggcactccctgcacgggcatctctgtgtagcttgaagctggactctctctcaggtgtaagtgggagctccttagaggtggggcttgaggacagaacccagcctcctgcctgtgccgacactgctccctctgtgactgtgagagacattgcagcccttcactatagcttggttggagactgacatctgtgaaggattgatgggaggctctgaaggtgctgtaatgaagtttcctccccaggatcccttccctgccccagccaggttggccccccagaaggctgctgggtccattcactgttctctacgtctgtgcgcagcccccaaccccgcccatgtcagcattatcccctaggacccagagcctcctcccatctcctggcttccactctaaacagaatgacctagtattattattattattattcgagatggagtttcactcttattgcccaggctggagtgcaatggtgctatctcggctcactgcaacccctgcctcccaggttcaagtgattctcctgcctcagcctcccgagtagctgggattacaggtgtgcaccaccacacccagttttttttttgtgtgtgtgttttttattgttagtagggatggggttttaccatgttgttcaagctggtctcaaactcctgatctcaagtgatccacccgcttcagcctcccaaaatgctgagattacaggtgtgagcctctgtgcccagccttcagaatgaccttttaaaggtcatcagggcatgattcctgcccctccttaacatccacctgtggcttctcagggactcagggtaaatgagctgggccctgcaccatctgttcttgctccctttgctcctgtgggtggaggcaggtgtcatgggcagcagagattctgcagagtcccctgtgaggtgaggggagtgcagaggattcgcgtggcctgggacttgccatggcgtgtgggaataggcagtggtcagctggggacactgaccacactagcagagctgctgccagtggcccccaaggcgtctcacctcctgacagcactgctatagcattgccagatgttattttgagttttaaacacaggagtgtggattgggctgcagtgtggattaactaggcctggggacctaccctgaggagctagtgatttacctatttcctcctccattcctgtagcattctcttactgagcacctgctgtatgcctggccctgggtatttggtggggccaactagactgcagctgttggtccaggtggggggtgaccgggatgggaagcccaatacggctccacagagagtaagaaagctgtgggggcagtgagctagggaggacagcagagagagcagggcctctgcaggggggtgagttccccaagaagaccctgcgattcattcagctgtttttcattgacaccatcatcatcatcgtcatcactgttaatacaaatgctgtacgtaacagagaagactgacttctgcttccatcttcgatgagaccctttgctcagttgagagaaaacccaccaaagaggggaagggaaggaggagagattctgccccccaggggagcagcccacatagccgcctgcaagaggcctgtgtacccaccctgggcatacctcctccagagccagaggggtgcctggtgtgggtcagtgctccccaccagaccagtgcctccgacccaagtcagtgcctcccacccaggccagtgccccccacccaagtcaatgcctcccacctaggccagtgtccccaacccagtcagtgcccccaacctgggtcagtaccctctacccaggccagccccatcccaccaggccagtgtcccccaccctggtcagtgccttccactgggccaatgccccccattctgcccatgccccccaactgggtccgtgcctcccaccaggacagtgtcccttatccagtcagtgcctcccactcagtcattgcccccaactaggtcagctctccccactaggtcagtgctcctcaccaggacagtgcccccgacctgggccagttcgccccacccaggccaataccctccacatgggtcagtgcccacaaccatgtcaatgctccccacccagatgtgtgttccccccccaccaccagactagtgcccctcaaccaggccagtgccccaggcagccttgggtttgcgcctcagctggtgacagctgaggctggtgtgtggtgcagtgtgggaacgtaccctgtgggatgttctgcactggaggtggggatctgtcccactcaaacctgcttctcagggggatgcagaggtgaatagggcattgtggcagtagccaagggcgggtggatggcccagctggtagaagtagctggggatagagaagtcaccaaatagatgcagagaagggaaggagaggcatggagagcaggcaggagcatgatctcagctatgtccccgaggagcagagagaactccgtggctggctagacaggcgggaagggaagcgcatctatgtctgtcatccttgtccctgcagttctggagcctggttcagtttctgctggggtagaagcacctcagagcagagtgatggctgccctagttcccatggtctgtgggtcattgaaggagggtccctcacggctcagggaaaaaccatttctgagcccaggctgggtgggggatgatttaggtcactttgctccaggtggtgagccccaccctgaccttgactttggccaactgttgtctgccagccctgcaggaggatgagccccggggtcctcagggagtgccagctgaaaggggtgtcagtcaaatgctcctcggagcacacccgttccgtgctccctctggccaggccttccctggctcctgtgggtccaggtccgtttccccacactgacataccccatcagctcaccctgtgaaatatccctgatctaaccttcttccacccctggtctggtccctctgtgtctctccccaggatgacagagctgccaccagagggtcctgtttctgcccttgccctagcatctattctcaaacagtgaccagagtgatcctgttgaaagggaaggcagatcatgccagtcctcaactcagaattccccagtgcctcccatcactgtcagagaaaaagccaggccgtatgacacggcccacgccggcctgcaccaacccccacccactgcctccctggtgatgtctccccccagtgccctctgggtcacctgcttcagccacaccagccctgtcttccccacaagccactgggcaggctcccccagggcatttgcagatgaggccccctcagctcctctccccatgggtgttgcctccatgccacctgctcacggggcctcctctgaccactccagttaaaactgcgaccctgcctccccaaggactgcctgctgctttctccaaaggacctctcactctttagctttcttgggattttatttatagattttattttgttatttcagatgaaaatttgaagcttgcaggggcagggatattttcccatttgggttactgctgtgaccacatattccagaaagtgtttggcacatcagggtccttgacacatccttgagtggccatccttaagatcaccctaagggtgatcttaagtctgccagccaccagggccttttgaagcagggagacctcccatgatgtacccctaggccttagccttgcaccccaggacaggaggactgcgctcccaggggagtcaccaagcatcatcatggggtgacatttccttccatttcctaaagtttccttgcatgagctcacaggaaaccttgaattgtaaggcccttcctttgccctgtacttgccgaacctaaaagccagttctgcccggaatgttctaaataatcagggggataaagaaagagaatcctcaagcaaggcttttctttcactctctgctcagttggcagcaccagatggaggatgtggccgtggtgtgggctcgtttatttattgattaaaatgcttacaaaacccagcatgtacagccaggctgaacattcaattaaaaagcccaaaatgaaaattcagaactcctgaatgacaagtaggatgtgcagagccagctcttagcaaaggaataggatgataaagctttaagcagggatttgttctatttatttatttcgctctttcttcaagaatttggaaactggaaggcactgcacagtgcccagtcactgcatgggtgagtgaatgaacaaagcttacacagtgttgggtgagcagcaaggataagagaggtggacatttgatgacagctaggtgcatgtgtccctgcacacacagggatgggaagaataatggccctgagatatgctctcgagagggcatcctgaaatttttttttcttttctttgagatagagtctcactctgtcgcccaggctggagtgcagtgaacctccacctccagggttcaagcagttctcctgtcttagcttcccgagtagctgggactatagtcgcacgccaccatgtctggctaatttttgtatttttagtagagatggggtttcaccacgttggtcaggctggtctccaactcctcacctcaagtgatccacccacctcagtgtcccaaagtgctgggattataggtgtgagccactgcgcccatccgcaccctgagtttttataccaggtaagcccttgagtgaggaaaagacatgaatccatgctccagagatgacaggcatccttttccataggggatggttaggggtatgattggcaaatatgcactgggacttcaggttcttcctggtggtaagaaaccactcgtcctccatccatcttcctcttccttctccatccaaccaccttcctcttcctccttcaccaccttccaacatcagactgagcacactcttcagagcccaccagctggagcagacttcatgtgggttgggctccacctcctttctcagaagtgagtgtcatcacctagagtgtcattaccacagtctttgccttccaaggctcctactaaatcagaacgacttaaaaagcaagcagagtgccctctctgctgctttggaggcagctgggccatggttagaaggtgagggccacagcatggctgctggctaccagctgcagatgctggtgccgactagccttgcctgagtctggcttcctcatctgcagaggggcagggtgtctcacttgaaagttgggagacttcaatacagttgtgtatgaagtgcccagtacagtaaattctcaataaataatcattgctattttaatactgtgggaatagaaggccagctcactagctgcaagccttagattagtccaaagacagcagagtcaagagggggattgccctggttcctctgcgcaggctgatgtcaggggtttgctgatctctgtgcaccgggactcagactttctcccgtgtggccacacttgctgtgtgtggtgtgtgtctgtgtgtgtatgtggtggggggcgggctgtgtatctgtgtgacgtgtgtgtgtgtgtgtgtttgtgtatgttttgtgtgtggtggggggaccttgggtctctgtctgtgtatgaactcatgtagtctcccctgcattcctctcctccggggattgctggccccttcgctgtttgatggcaggtgtctgaggatggagagggcagtgccgcagagtgacagcacagggcatgccaggacaccagggtgcccagagcccataaaccacagcctctgacagcctagtgtctacgctaccaccgtccccagggcctctgtgggctcagagcattctccccacctcaggccatgccgagaccactaggctcctttgcatagaaatttgagctgtattttgttgttttgaggagaaaagtggtttctcaaaggcctttgattcccatgtatttgctaagctggccttgcactttcctacccatcctttttgggtgggttgcccacaggtaccatccttcttgtcttcattctggccctgtcttgcctctttagcatgtttgagaattttggacaaatggagagaagtctgttctcaagggtgttggcctaagtagcttccccggtgcgggaccggggtccattttctgccctccttcccgcagcctctcctgcatgtcttcctggacctgtgctgatttcagcatcttcgttgtgtgactcagttcttctcaggaagccatagaggtttttctttctagagctttgagcatttgaagaattctgcccactgtgtcttctctcctcccactgcaatcgatagcagagaatggagaggctggtcattttttcagactgctctgttgaacacggatctgcaaagctggcgttggtactcctacagccagtgctgggacacatgcaatttgtggtgtgtgatgctttcaggttgctctaagtgtcagtttgacatacctgaatcctggggcatttttttgtgactgtaatcatccataacagcatatctgtgatggatcagtcaggatgggaaagttaggctgcaggaacagcaaggtgaaatgcttgctgcttctgttcatgctgaccatacccaaacacagaactggtgcaatcctgccatgccatggaggcagagagccaggaataaccaggcacaacatgtgcctcctcttagggcccccataggggagggctctgcctgcaccgaagatgctccacagccctctaggagcttggggaccaggccagagaccctgtgctgtgctgctgacagtgctaaattttgacagtgctaaatttcactgctgcgtaggggattagccagcccaggccgccaggtctggctcgggatggcgtgacctctggagttttccacagtcctgccattggaagtgatcccgggagacaaggcatcatggtgctcctatgttcttcctgttttcagacacgacatttcacctgcctctcggaggctgaaataagttaaataaggttatgctggagaaaagtggacattctagtgatctctacatctgaacatgagatcagattatctgatctccttagctttttttgtttgtttgttttttgaggcagagtcttgctctgtcctccaggctggagtgcagtggcatgatcttagctcactgcaacctctgcctcccaggttcaagcgattctcctgcctcagcctccctagtagctgggattacaggcatgcaccaccatgccctactaattttgtatttttggtagaggcggggtttcatcatgctggccaggctggtctccaactcctgacctcaggtgatccgtccgcctcagcctcacaaggtgctaggactgcaggcgtgagccaccgcgcccggccgatctccttagtttttaaactccactgtagccaaagaactttgggagagattcacttggccccaacaggatctgaggaccacctccctcacatatgcttcccagtgaatttggaacgtccatccatgtgaggaaagagcttgcctctggcagggttaagacaaggtgtgcgttcagttgaatgaaggtgggcactccccactttgggggccagacttttctccttcgctcacactatatttttaatgtaggatgatctttgtgtagactggtacatggcagaacactaagaagatgaaactttttaagtgaaaatattttcaggcctaggtagccagtaaggtgaccctgcaatggtctgtttccttctgagcctccaggaaggaaacccacccgatgatgcccaagggacgggagagggccgccacacgggctggcgagacaaagtcagggaggcaacagagccagctggcaagtgcaggagactgcccacattcgggttttgttttgcttggtattttagttttttaaaaaccactttgttgaggcctggttggcatataaaaagctgggcatattttacatacttaatttctacatctcgatgagtctgggggtgagtctgtgaagccatcaccaccatcaagaccgtgaacaagttcatcacctctcagagttgtgcatcgcctcctgcctcctttgttattaacattgttattatttttggtaagaatccttactataagatataaccccgtctctactgaaaatacaaaattagccaggcatggtggcacttgcctataatctcagctacttcagaggctgaggcaggagaattgcttgaacctggaaagcagaggttgcagtgagctgagatcgcgccattgcactccagcctgggcaacaggagcaaaactccatctcaaaaaaaaaaaagaaagatctactctgctagcagttttaagtagacagtacagtattgttagctggagtcacactgctgtacagtagatctccagaacttactcatcttgcagaactaaactatagtcttggaccaacacctccccattccaaccccagcccctggtaaccaccattctactccctgcttctaggagattgactttttagctccaacatataagtgagatcatgtggtatttgttttcctgtgactggcttatttcgtttaacataatgtcctccaagttcatccatgttgtcacaaatgacaagacttccttcttttttaaggctgagttgccccacgttgtctgctaggggttccttgttccctgtctctggacctgcttcctgagtctcctctctccaaccccagggtgtcagtgatgttggctctgactgggtaagagtggttaactccgctgcacccgtcggcactgccctcaccctctatctttaagttcagactatttagagctatttgagtttgtatttaaatgaattaaaattagataaaattaaacatttgatttctccgtctcactagccactattcagtgcttggtgctagtgaccacagcatataggagctaatctagggagaggtgcagcctgtggaggaaaggagcagggacccggctcagccctgcccgggacagctgtgaattgctagattagacctcgtgagagccacttcagggggaaatgggagctcagagagccaccttagaagacatggggtgacgctgctgaggtcaagtgccagagtgaaaactgctcggttgggtttctgtcctgtctgtaaaatcagcgtcaacttatgagtaggaatgtttaatgtgtgttgagtgcctcatttgtctggatatctggtttcactggtacttccccagcctgggtttgttgcggttccccgtctgaatgttatttgggtccatgctgtaagactgccttctaagagacttctgattattctgataatattaatctcttagaaaggggtccacagtgggggttatgttgatcttctgggttagttgccagggttgtgatgttctaatatatctctttctcagctggttttaacctgctgacggtttccccctgggaagttcagtgattcattccagactggaggcgttttgactgaggcctgtcatgaagttccctgagaggatgaagcgcctcttctgtggttacctttaatggcaggtatggccatggaggcccatacaggtgtctcggggcaatcaaaggccccttcttaggggaacatcgtgcttcctatttccctgtctccagcccagttctggcccctggaggctcaaggagcacctgctagtttccttctggtctctccaccttacttcccactctgggcgcagaagtgctgtgtggaaattatgcaccaggaagctccgtacaagcagtagagagtctcagctaagctaagggagatgagaatacaaaggtctggcaggtcctcttgactgtgggcctcatgtgcactcagcattcgctcagttccactgcatgcctgtcactgtacactccttcatgtgcggtgtgtggctacaatgcgggaggacgcacattccaggcagtgttctctgcggttccctgagacagatgccacaaaacttgctggaggtggtctcagaggctggggctgctcggcatctctcactgagaaagagcaggtgacagagaagaaagcaatccacgcagagccctttcccacaccaggagttcccctgagctctgccctttgggctgctcctccagctgctcctccagctgccccttccttgctcattcagcacggtatttagtgagcacagtagatctgggcattacagagctacaggtgacttcaggagtgattcgctgccttctgctgggctcttactggcagcgacagtgggatgtgcttgggatattgcttttgtctacctcacgctaaagttgtttcattcaacatcagcaggaagcagataacattgtcaacacgtcgcttatagagaaaatccactaaaatggtcagagcagaccgtctttcagaagagatgcagtctgccagatgcagaccccaggaagtgtcagcagtggggccgggatgaggggtggatagaggggtgccacgtgtgtgtttgcattccaccctgcgatgttgttctgacccctgtgtgtccctgcctccaacccctgcgcatactccagcagcacctgcagagtgcttggagattcctcctggaggcttcccggggcttccgattccatcctgctgctgcccttgcaggcaggctgcacataccgcagaaggtatgggagcagagcaggtgccatggaggggcagggcagggcctctttgtacatctccgacctgcccttgtggatgctttttctctgaccgtacagtggctggtggtgttctccaggcaggaagctacatgccatggccgcaacccactgttatgcaagtatcggaatgatttcatgctgttagcagtcggtggaccccaaatgcccagtaacctagcatgttactgaagacaactccaacctggatggcagaatcacatttcctgttgcttggtgattccactaggggatggtgcaggaagaaactaaaaaactacagggacctttgatagactggttgattacgtatttcctaggttgctctggtcgacgtgtatgttgagtaagctgcaggagagccaaagcttggttcaacgggtgtgcggtgtacggtagggccgcggcatgcatgcccgtgtggatggctgatggtgtgctatggaggtgtttttgctcaattgcttgccgcttggcatgaacaacacaggtaacataattgagggcacacattattatggcagtgcagttttaatttataaatgtgaggcttttgtgtctttattgattctttgtgtaatcaacagacattctttatttctctcttacagtggcttgaaattaaaaaaataaaaagtacctgttgtactcttcatgagggaacattcacatttagtttccactgctgggaggtgcacatttgaaaattgaatattcataattacctttttgcacattggacttgtgtgtagccacattgatttaattcgcaaatttgcattgtaatatatgatattgaagatgttctgctaggatgctcacaggagcacttggccagaagttaggaggggaacaatttgtgggcaagcagaacgctgcatccatgctctgggcggaagcttggagcagataagatgcactttttttttttattattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgctcttgcgatagtttactgagaatgatgatttccaatttcatccatgtccctacaaaggacacgaactcatcattttttatggctgcatagtactccatggtgtatatgtgccacattttcttaatccagtctatcattgttggacatttgggttggttccaagtctttgctattgtgaataatgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaagtgttcctatttctccacatcctctccagcacctgttgtttcctgactttttaatgattgccattctaactggtgtgagatggtatctcattgtggttttgatttgcatttccctgatggccagtgatgatgagcattttttcatgtgttttttggctgcataaatgtcttcttttgagaagtgtctgttcacatcgtttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccaattttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggcccttttttggttccatgtgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaactgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaaaagagctcctgaaggaagcgctaaacatggaaaggaacaaccggtaccagctgctgcaaaatcatgccaaaatgtgaagaccattgagactagcaagaaactgcatcaactaacgagcaaaatcactagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctgaaaataaaaggatggaggaagatctaccaagcaaatggaaaacaaaaaaaggcagggagtctctgataaaacagactttaaaccaacaaagatcaaaagagacaaagaaggccattatataatggtaaagggatcaattcaacaagaagagctaactatcctaaatagatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaagaattgaactcagctctgcaccaggtggacctaatagacatctacagaactctccaccccaaatcaacagaatatacatttttttcagcaccacaccacacctattccaaaattgaccacatggttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcagtgaatccaggagctggttttttgaaaggatcaacaagattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagatgttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattagtcaggagaaggaaataaagggtattcaatgaggaaaagaggaagtcaaattgtccctgtttgcagacgacatgattgtatatcaagatgcacttttattctagcttcctaaaagcaatggcccttgatggcaagactgaaggactgctgagcacttgagaggagacccagtctgtggacatgcctttctgactgatgtaccctggtggtggttttgtttttccttgtctgacttcactctgaaaagggcgctaatttcaagcgatgagcaagtcatatcaaggctacccatatggcagagacagcaaactttactaaaatggtggtttgtccctttctttattgttatttttttaattaaagtttgaagttgttttctcgttttcttacatccacattttcttccatgccctgccagtggatgagatggagtcacagattttggagctgatgtcttccatgagtcgtggctgtgtggtggtgaggtcggctgctgctggtgctgtccagttttgaactgacttgagcgttgtggccggtgtagcagtcagccatagactaggggaaccttggtgtatgtgtttttatggtttcctttagcattgttagttcaaaagtatgtcacctattcagaactggttatttggttatttcagaactccaaatcttacaaagtctaatgaaaatcttacacaatcttacacagtttagtaaacaaaacacacaaggccagagggacaaatgtacctcagagctggggctctgagtcctgcccacttttcttgtgaatgagcttcccactcgaggttggcttgctcctctttctaataattctaacaagtttaacgggttttttattgtggtataatacttataacatgaaagtcattataaagtgtgccagtggaatttatgttttattatattaatgatgtttcgaccgtcagcactgtctagttccagaagtttccttttgggaagttttcatctccccaaaaggaaactctctacccatcagcagccaccccgctgggccccttcttcctggccccaggccaccacaacctgctttctttctctgtgaatttgcccactctggagatttgatataagtggaatcatccgatacatggccctttggtctagcttcttttacttcgtattttcgaagttcatccaggatcatagagtatatcagaattccattcccctctatagctgaagaatgtcccactgtatggtatttccacattttgtttatccattcatctgctgacggacattgggctgtttccaccttttggctcttgtgggtagagctgcacttaacatttgggtacaaacatttgcttgaacacctgtcttagattttgggtgtatacctaggaatggacttgctgggtcacgtggtcatcctaggtgtacgttattgaagagccgccctatgttttccacagcagcccttggatttcacttttatctacagtaatgcggaagaagggggctgatttgtgacaggtgggcaaatctgcagtgttaagaagaggcaggagacagggaacccatgcaatccacatacttcagaggcaggtggtgctcctggctcacactgtaggtaatatttgccctgtgcctgtcagcttcatctgtgtgcatgggctgagctgggaagaaccaggggacctggaaaggggttagggagcttgtctatgccagcatccttgacaccggcatgatatcaggatccctattcctcttcacaaggcccaggccttaccccaaacctgctgtacatccatcccaaggggggaggctggcatctgtgtttcttgctgcatttatttaaatgcagttcagcctaatgcacagcccgggatgagactgcaggtgaagtgtcatattttaagatgtgctcatgagaggcatggatacaaggccaggcctccctggctgacatttgggtgcttgccatgggccaggccctgccctccttgctgggtgagcgctgtaccagttggtcatcgcaatggtcttaagcatcactgaggaagacattgaggcccagatagggactgtccttggccaaggcctcctagccttgagtaggggccccggccagcagtggggctcactgcctctcaggctcaacatcccagggggatgggaagaaaacattctgggagatgagtggagagagactgattctctgtaggtgatggcatgtgccttgagctgaaaggtgcttccggtttctttgtagcgatggggtcagctgctccaggcagctgtggcagcatgagtgaaacagaggggcttattccagtgcatgtgggggagaggagggaggtgggctcagccagagcagagggatttgaagagtggcagtggaggagatatttgaaaggtgtgttgggacccgtatgcagggtgccgtgtttggactttgttttgtagggcacaagacagttgaaggctttggaactgggaggaaagtgacaagaaggagtaccaggctgtgggacactggacactgagaaaaggaagaggctatgggggaagagaggggccgtgagacccggggcaagtgtggacttgggggacacagtagcggaaagcagcaggcctgggcagtcacctaactgcaggtgccaaggtcgtggtctgtgtcccgggagaccagcgggtgggtgtccagagatgggggcaccagaaccatgtgggtcatgtatatttaatgctgcctgcttgagaaagcaggggcttggcatatgttttaggagaaagttttatttcttgaaatggttaaactgataaatcctcagttatcccaaaggctcagggttccagaaaatggctccgttgaagggtgaatcccatagatcttataagagtgattgtaaccctgccttggtatagccagggagcagagatagagggtaggaaccagattgccctggggaaagcaggtcagcctgaaacggcatgacctttgatgtcacctccgtgcaggaatgaatttctctaccatatgaatagcaccatcaactaatacatttttattattcctgccacttcataaatagtgtctccatcttaatttgcatgtgtctgtcactctccatggtctttaaaggtttgtataaacttgtaaattaatcctcctttacatgcataaggcaaaccagctccttgatgaaacctttgatgaatctttttacaagtgcataatatccaccagccaatttcttattctgtaaattattttgccattttggttttgtttaatttagggtgtgacagtactggcatcatatttctgtctagtgaataggagaatcagaccaccaaaatattagaggagaccctctgagttggtagagattgaagcagagctaagccctcgctggtgaccaaaagaaacttcgtctccccgtatgaatctcattcttggcaaagcccacagtttgagaacccccagcaggcattccagagctgcactgtcccataaggtagccaccgaccacactcagtgaacagcgaccacattgaagagcccatacacgacacgtttccatcagtgcagaaagttccactggacagcactgctccacaataatgaagaaaaaggaaacctgttttactttactgagtataattagcagaaagtcttatttgatgacttttctctgggtcccccttgtcaagtgtgagtcctctgagtggagagggctatagtctctccatagtaaggcagaaagacgtgcccactgggaaacacccagcaatttaatagggccctgggtccaacaccaacttggagttcttaactaatgccaagccaggtaaagtgctttgttcattgagtcttgcaactccattagtgattcaaaacaaagtaaacctctgtccctatctctgtaggatagttgcagggaagcaatagcttgtgtctgtagaatgcacttgcttttactaagaggcagtaaggaactgtctcagtatgaaaatgtgcatatacagaacgaccatccgtttttggtgtaagcaaaggggaccatgtgtgcctgttgtgcactgtctgtgcagaactttcagaaactgtcagtgatgcacaaggacgtgtgtgtccagagaagagacgcctgtgcaggctttcctggcagtctataaaggggcgagctctgtctcagtccaggctttcccacccagggttcctctggggctctttcatctcattatgtctggctattgtgacatttagagtattcaggtgaatgccggttgctgccttggtgtggaagggacgtcgtcgcttttccaccctagaatgacctttgatcttacctgtcaggacgtgatctaggcatcaaagccaccagttcccagaacgtcacctgcgaccagcataggtctgtgtctctgggttgttttggagaatatggagccttttgagatgcattagcagaagtctttttggtctgactgtgtgagattatatgtgcatgcatcaggggcttttttcacccaaattgcaaagattcccagtatttagagattagatgtggttagaaaagtgcatttccagtatgcaattgtaaagcaggaaaaacctaaagctttcaaaaagagagggcaaggcaggctggaggaggtgttcagagctggttttgctgaacttttgggcctggggaaggttccaccagtgtcctggctcttgggcttcatctctcgcagcagatctgcacagctccaactgggctatcagtgctgtgggcctcggtccaggaggctgggtggatgctgggaaggggatggagggaggacatgttgccaggtgatggtggctggctctacatgcccctgctcctggagaagccctggtgccatgtttctccctggctctggcttcctgtctatcacaggaggaacacaggtgtgatgtcagtgtgatcttcactacacacagcctttaacaaggtagcccatgacatggagagaacttatcactcctcttagagatttcctctgcttttctgttttaaatagactttctgttttagagcagttttaggttcacagcaagattgagcagaaggtacagagaattcccatagacctcctgccccgcccccatgtgcagcctttccatcagcatcagccaccagagtggtgtcacattagggtttactcttggtgttggacattccacgggtttggacaaatctataatgcgatgtatccaccattagagtttcacactcagtactttccctgcccttaaaaatccatgtgctctatctggttatccctccctggcctcaccctctggctgccgtgggtctttgtactgtcgctgtagttctgcgttctccagaacatcatacagttggaagtatacagtgcgtagccttttcagactggcttctctctcttagtaattcatgtttgaggttcctccatgtcttttcatggcttcatagttgatttctttttatcactgaataacactccattgtctgggtggaccccagtttgtttatccactcacctcctgaggctatcttggtggcttccgcattctggcagttatgaataaagctgctctaaactttcatgagtgggtttctcatgaaatgttttcatgagatgtaagtttcatgaaatgttttgtggatgtaagttttcatggtgttggggttttcgggaccccagcttacctcccacccggatggaatctcctagtgtagcatttcctgcttgtgcacagatagcgtcaagtcttgcccatggtgacagggcgacagcaatgcctgtccctgagggggcgtctgtgggcaggtgggcaggtgccgccccagccccagggggtggaggagagtccagaggtctggggctctttttccctgttagcgctcagaagggacactgtctactccatgctggggaggcccagccccccaccctgctcttcccctgggtctgggaggcatagctctggcagcagccccgttcacagcagggacttggttctaggtctcgttctgccgggcctgcctcatctctttccctgctccttctgaggtacagaacagtcaaagtccaccttggtttctgtgacttgctgggcctggaaaaagagaactggctgagtttaaatgacttcaggtacataaatattagttgctgcagtttctccaccacggaatcacagtgaggtcagtgtggagtgcgagggtgcctccctgtgaacaggcttctgctcgtgagtgcctttgtagtgtcctggtgctaactggggatgtatcctaggactttaagaactagcgcatccgtcttgggtcaggtttctcaggaaggcacataactggagtcccagccaagaggaaagatgtatgtggccagcagcagctcgctggctgcaccgctgaggggactcgcacaactctgccgcttgtcctgatggattctgtggcaaaggccaaggatggcctgcatctgaacggaaggccaggcattaaaaagcaaagggcagggaggatcatcgtgatcctttctctcctctgtttttctaagccatgagcacgctgaatttcagtacgcaaaaaaaaaaagccccctttaagcagaaaaaccattctagggacattgagagactagaaatccttgcctaatttcagattaagcaaaacataagcatttggcaaatgccgagattgtaaagttgtgcaagcagaagaatcactttgaaatttgagcgcagccccagatgttcgggagcatttccatgcgactgctcctcctagcgtgactggctggtgcctcccggcccccagcccggtccccagtgcttgtcctctgcccactcgctgcacagacctggggtgaggaagaaatgccgccgagcgccagaagattaggagggaattgtgtgaggcctcctctcaaagccagggtggctctcggcatacgcgtttatctgagtgactgaatcatagcacaatcattttggcgaccgtgggataaacgctgtgagagaactgtggtttgtccttgcgggtgtgttggttcaaagtcatgtgagtagagccagctcctgaggggatcgtctcatgctcacactgggggcagcatttgtctcttgtcagctgtgagatcagagtcctagggaagccagaatggtctctcagatcatgccctggccagaatccggggctgccctggccagccgccagatactgacccttctggtctcatccaatctaaagacaaagcatgaaagcccagccctgacgagctctggcctgaggccacccatccactcagaggcagacattggcttggagaagaaagagggatgaacttctggaaccaaagccagctggaattccttgcctctggtaggtgagccaagtgaattcaatatgtaatgaaactgtacttcataacttccctgagaacatttgtatttcaagtgtctgtcccagaacagatcaaagccctctgctaactgggattacagatgggaaaggagtggctctccatcgatcctggtgtttgtatcctgcctggaacagctcactttagggacagcagctgcttgtaggtgtctgcagaagaggcactcccatctctgcctagatgggggcatggcttagtaactctccagtaccctgttcttggctgtcgccctgtatatgccagatagtgacagtggcatcgttttgcaggaccaagtgttaagcttgctgcattttttggagttgagaaagagttggttcctggcatcgtgatatgaactctacatttatttcccctcttcctaagccagtgcaggttagttgactgcaaagagacaatgtcctgagctgtgtctgcctgtgggctcagtggggtcccggggatcacccaggcatccttttcagcctgctgggctgaaagcttggatttacaagtgattcgttttcttactcttgcacttctgctggggtagtgacggtggtcaagagaaacacatgttagtacagatgtgtattctgagtgagagggggctcacagggctgaaaacaagcccagtggggctcgttccagaacagaaagccccacactcccccatcttctcttatcatccctgttgtttttaaacattccccttatcatctcctcctctctttttaaagtgtgcgatcttgaagagtgccgtgccggagccaaatggtgtgggcaggtgcagcctgcctgcccccagcctgtccaggccgtgtgtggctgtttcccttcactgcccagtccaatctggagctttttccagccaaacaaaggcacctctgtccccttagaggaaagagagccagtaggagtatcagcccatttgccctgcatttgggacctagaaatcccccggtggttacatctggggtccctccttgcaggggcaaggtgaacgagctgctgtgagaagtaagagaagtcagagtgggtgatggagagtggggggtgctattctggaggttcccagctggagctgtttccattctaggtcttcacggagctacttcctcgaagctgggggtggcctcttatggtcccttccttaggcctggaaccaagtcctactagtgctcctgtaaagcctgtagaagcaacacaactcttctctcaccccagttctcatggccgtcacagccctcggcttgcctctgctcggctcattgactctaattccatttttgagggctgctttccgggcagaggagggcggtgggaatgagagcagaggtttccttcctgttctctgcacagcagccagtggccacctggactagagagggaggtacaggccctcaccctttcccaagcccacctgagcagcaggtacaacgtttgatctcaccacagtgagtgcaaaaccatccttcctgctggaaccaccgcaggcgcccatcctcggcagtgagccacaacttcctcctcacgtcttcttaaccaaggccagttataccctttcatgctcaaagggaggctgtcctacctgctggatacatgtttgttatctgggagaagtttaggcctctccccacctaatcagaatgtctaaaccctctgcttactaggtcaccaaaatcagtgctggattccagctctataacacccaatatgcacaactgttgttcttgtaaaattactggcattcctcttctgtaaagatatcagccccgcagatgaacagacaagtaaacaacgtcaggcagatgaactttctgctgggagaaaataaaactcgaggcacattgctttgcttgctgtacatggacaggcagagtggtcagatggaatggccatggattcgggcaccagaccaagattcaaatccctgccctacgatactcatcacctgggttaaccttctgaaccacaaacacttcatctgtaaagtgatggtaatattgccatcttgcagggttttaggatatggattagattgtatgtaaggcatctacatacctacatagattgttccatgggagctcaaaaatggctgctcttactgataacttatagacatgtaagtaatgattactactgataatgattagtgataagtagtattcatggaagaaagactcacggacacacaagacgccatgtgcatggatgcacctctcaaacgcttctttgcagctcttcacattctttgaggtatgcagtcagtaatagaactcaaaccttatatcctcggattcacttttaattaggctgttctcattaaaacgccattcctttattgtcttgccacttaatttagtaaattggtagagcaaatgtggcatgcagattgcctcttccataccagaacgtcatcattcattgccaaagcctatgtggattaggagcatttgaagtggaaattagttgagttcagggcatacagttgttgaattttgattatcagcttatagtatttttaaaattagattatgctttgtttccatttaacaaaggaagataaatgttgtggttgatgtttttattaaaatagaaatttaacaaacattctccaataactggatggattacaggagatgagacaatcaatagaggattacattttgcaaagccaatttaggaaccttgtctagataaaaccctcttgtggcagaagggatctggcaaaaatgaataaatttgtaataagtgtcaaccctggccccctgccgtgcaactcaagtatagacagatttttggagggaagatctacttccaactactgttattctgctagagagatgtgttcgcgagggattggtcacattttgacatcagaggctggccatgacaatcccaaggttctgccaaattccagtggattcccactgcttacttcaagtcccagtgtggtcaggacttcaggacttctctgaaggggagatggggcccttttctggaggatcagagctctgaagatgattggtcctcgttattcagtatgaaagcaaataccacatttcaagaagtggatggctctttttaaaataagtcaccttggcaactggaaggcacagcaaggagcgagaaagggtaagggagagaagcggggagagggaaagaatgaggaaagggaaaaagaagggtaaggagtaagggggaggaagagagagacaagacacggatacacaggagactcagcgccccttcaagcattctggaatcccccgaataatcaccactccttctcccttcttgctggaactttgtgtattttgcatttcctgttgaagtcataaatccagatcctgctctgtaaacccatggagtctgagggcagccagggccggcagaggcagaacatttcaacatgtgccgaaatgttcccacaggcagactaggcagttggggtggcaggaatccaggagcctgaactaggaggcgggtgagttgtctttgcctgagagttgagcttaaatcagccaataaaattgtccatcttaaggaagctgaaatttctaaataagcctataaataatttcacaaatagggcctgtgctgtgtaatagtgtgcactgattttgagagttactgcaagaataaatttgctgaatgaataaatctgcagtagtcgccagtcaaatgtcaaaggctggtctccagcagaaataaccttttaaaaaggactcattagctgagcacacagggcacccacataagtgatttctaattcattaagaggtagatgatcagctcatattttgcttttccagcaaataaggattcaaataagaacccttctccaactcagaaatcaggcttctggtgcctgcaaatctccccacatcaggatatgggcagacagctttattgctatcaattaaagttccatgcacaaaccttgtaatgttaagatgaggccaagaggtggcttttccctggctagattggaatttagtgagagtgggcaggcaatataaagaggccaaatctgactgtgggcaaggctgctgagctgtgttgcagagggattttcttatacccctaggtggtctcgttgaaatgttttatcagagacaggagggagcttgcagactttgtggggcttctgcttttgccactgtgcccgggctcccagcatatgctccagagagaggcctcggcttccagagacaatgcaatgggtgggaaggggaggtgtgtatttctagagtgggaaggagggccgggggccatcaggaccctctggctcatcaggtcttgggctgggagtcattgggtgtatagcaggcactgactggcacaggggcaagtgtctatgaagcaggtgacacagaggaagacaaactgaagaagatacctgtatgactccagctataggatccacatattcaccacaatgggcatttgtgtaaatgaagaatcacaaacacacatatgcacatactatcccaaagaatattcagtgagatttagaaaaacaaccaacccaagtgcattctctgttagtgattggtagcatgctgtccctctccaggaagaatattgtaggtagtggtagatggggcataagtctgagcccccagcgaagcttgaactcagctgaatgtgcatctgcactggggctggagactcctgatgtgcatggggttttggtgaggttgagctgtgtgtccgccaagctccctgagcctgtgcctcgaggagataaggtgaaggtggcctgctcttccaccctcctgtaagagtgggcatgaggatgcttctctaagctgtcaacatgttttatagatgttaattatttttgttattttaggtctccaaatatttcagagtgctaatcttttagcttttcttatgtttttatctttttaaaagtaatttgtagtatagtgacagagctgtgcaaccaccatcactgtctaatttcagaaactttccatcactgtaaaaagaaatgccatacctatcagtagtcactctctgttccccttcccccagcccctggaaaacactaatgtaatttctgtccctgtggatctttctttctggacatttctatgaatggaagcagataatatgtggccttttgtgtcttacttctttcacttagcataatattttcaaggttcgtcttggttgtagcatgtttcactacttcatgtttttatggctgaataataatccattgtgtggctagaccacattttgcttataccattaatcagtggatggacatctgggatgttctcactttttcaccatcacaggtagtgccctgtgactattgatgtacaagttttttgtggacaggtttccactgctctaggagtaggggtactgggtcgcatggtaactctctttaaccttctgaggggctgccaggcagttgttccaagtggctgcaccattttccattcccaccggcaatgtatgacattccagtttctccacatctttgtcaacattcattattgccagtctttgtgattttagccatcctagtggatgtgaagtagttttgattaatcttttagattttaaaataataatgaaagttacaactgtcatcttaatagaaggaaaaccaggttgatgatctgttgactaatatttgcaaagtgctaataagccctttgaagacagtatttgaagaaggcgaagttgatcctttctcctggaactcctttctcctggatcccaaagctgtggatccctgctggtagtaaagtagatgaaattagaattgctgcataagcgccaaatgacttgaaggagagcatgaatgtccagacggggatagagaccaactatgaatctgcctgtaactccaaggacagtactctccgtccctctccttgaggtgtgtgcaagcacgcacgctggcacactgtctcctggaaggaacggtggagctgtcgcttccccaaaccctctcctcttgccattcctatacagtaatgactagtatagacaaatacaatcacacagttttggcaaggaaaagtttgttctgggagaggcctttggcttgcgtaagagatgtttttaaaatgtgtgtggtttttgtgtcttgtttttcctagaggctagaagggaggatgccatggctctgacaaggcccaagaggtcagggaggggtcccttggccacatttcctctgcagtgctcggaaacaactcactggtctttaattttctgtgaagatcagtgtctcacttcatccctccagctggcatggctggagtcaaagtgagtcggtttacacagagtaagccaagaaatcgtagaatcccaggagtcattggatttcagggactgccatttaatttctttctttctttctttctttttttttttttttttttttttttttggagaccaggtcttgctctgtcactcaggctggagtacagtggtgtgatcatggctcactgtaatctcaaaccctgggctctagcagtcctcccacttcagcctcctgagtagatgggactacaggcatgtgccaccatgtacagcatatcatttcctttcttggttccccgcttcccccagtgacacagcccctttacaacatcccttaatatggctgctctgagtctgctttaatccaaaacagttacagaactcactcaccacttcccaaagcagcctgttccattctcagcactgatcgctagaaggttcttttctatatgcccactcatctcctggtttccaagccaggcatcactacatgttccttggaatgtcctgcagactctaccagcctggagtagtgtgtaggggttcaggtgcctgctgcaccctccttattactgcagggcaaagatgctggcccgagcagggaccacacctccctttgttccaaatcactcctgggaaaaagttcagagagggttgaaagtatgcatagtgtttccattagaaatgaatagtctttctgctttatttttaatgatattttcactgtgaaccgtaacgtatatgtcatgtttaaagaagaacaacaacaaacattagtatatctaccatcagcctaagaaatgtggagacctagaggccctccaggggtatcctgggcgtatgccacattttctccaccatggtaaaacatttaaggacacacacgtatgtgggtctacattgtttatttgattttatctatctgttcttggtgctgaatattacagatttagcctcagaaggtgtttttctgtaacttgcttcttccacccaacaaggaatcagctgtgttgatgtacatagatgtcgctcatttgtttttttatgtagtgtacagtttttcatggatctgagtatatcatagactatctacttcacagttaatgggtatttcagttgttgttgttctttttttttaatgttcatgtagaagtacatccttaccctggagaatactatgttctttggaacaggatggcttggcgatcaggcagcactttgcactcctaccagcagtggtgagagacgtttccttctgcgcccttgccgacacttgctgttgccagacttttaaatttttgccaatctggtgggtgtgaaatggcatctcattgtggtttaatttgcagttcttggattaccaatgctgttgagtcacttttcaggtctttggggaccatttgtgttcatagccttttctacaatgcctgtttaagttaacttatctttttcttgaaagatctatctgttcttgaagatagatgggtagttcttacctggtgtttactgccactgttctaagtggttctggatacagtaactgtttcagtccttcccaataaagtaggttttcttagggggacgcctgtctcatgggagagtatccgtaggtgcgcacagccactggcccagtgttccccagcaggtgaggggagagcaggggctcacacctgagcacgctggctctaccattcggttccagttcaactgctgggttattgacatattttggatgctaataccttgtttctgcaatgtgttgttaatatcttctgtttatggattgtctttttccttcgtatttaatgtcttttgataaatggaaggtttttaaaaacatttaaatgttgttccactgaacatttatggtcagtgttttgtgtcttatttaaaaatcatttcctaccctggagctttttattaacttttaaaagttttatagttttgcttttcacatttaagatgttaattcagctagaaataatattgtatataggatgaggtggaggacaatttctttttccatctagataacctaacttgccaacaccattgattaaacagcccagcctttccctgccgctggtaaatcacatcatctgcacatgtttgtgtctggaccctcccttcagttccatcggtctatttgtctattgttgattaaactattcttttgtaattactgtaacttatttaaagctttgatattttagcagggcaaggactttcactcttccacatacattttaaatcaatttgtcaagtactttgtcaagtacttgaaaatcccgtcgagatttaaattggaaatgcatttgaactatacatcaagttgggagaaaattacagcttttctgagtcctcttactcaagaacatcatatttcttgcaatttatttaggccatctttaatatcttttagtaaaattgcataatatcctccataaaggaaatgtacatgtttggttaaatttctacctagtaccacttaaaatagcaacaaaaatataaagtatttttaattatatattttagctacttgtgcatggtagatagaaaagcagttgacttttacatatacataccacttcccagtgttcctgttttcatgtttgccctttgcataaattttcttttgtgtcagtttagcaattcatttctttttcttgttattatggataccttcaaacatacacaatcatggagggtctaggacaatgaccctgtgtcaggcgatatccagcatcagcagctgtcaacatggtgccaagcttattccatatgtccctccactttttttgttttttggggaatcctttaaagaaaatcccaggcatcatattattttatccttcaatatttcagtatgtattaccaacagatgaagtcttaaaacaaaaaacagccaaaccattgtcacactgtcagaattaacagtagttgcctgatattagtccatgtgtggatttccctcatagtctctaaaatgtctttttatgcttgttttgttcaaacctggattcaaataaggtccactcatggcataggattccatctctcttacttctttctatttctggaagttcctactcttttccacctatttccttcatgccattaatctgttgaagaacatagtccctttccctggagagctgccccacccttgactatgtgggctgcatcctcatggtgctgtctcccctgctcctccattccctgtatttcctgtaaactggtagttacatctgaggacttggctagattcatttgtttacacatgtttgtttttctaagaacactttctaggtggggctgtgagcctctgatttcgacagtgcattcagaatcatctttgtactttctaatctagcgttccaggttatccaggatgcctaggtcatggtactgatataggaagggaattccagaaacagcgtgggatgatgccattcaccattgtatgctcctggtcatcactgtgtcctgtgatctgtcagtatggtcttcctctcccccacatttgtgtgtgtgaaccacagtggttcatgaccactttggtggcaggaacatgaaaatatttcacctgaacacagtgttatccagaggtggaatgtctgagtgtcaaatatatccctggactcccagttgccttctccatgctctgagcagggctgagagctgaggcttccctggggttgttaacggggtggtcatgacaagcttggccacgtccttcctcccacgtcctggtggctgctctgtggtcttcttgaggaattggccatgtgtccacagaggcagtcatcttagtccagtggcctggaatcctctcacatttcttctgggaatatttatctcttccttttcttactctttcatctccaaatgttcccctctctcctacattggtttctctcgtgtggtttctctgcgcatttgtttggtgttccctctgtgctcagccttctcctggttttcccaattaccaggtccagtctctgaccagaccccatgaagcctggttgattgcttctaaatctctccatctgagaaacatcctggagatgtggaaaaaaacacaactcatgagaggaaaagacttttgcattgagagcaaatccgcatgaggaaaaagtcaagccccaaagaatcaagtggacctgcaggtggggttattcaccaagactttttcaatgagatgtaaatcagtggcttcaaatggttccagaggccatggctggagcggtgtctttccctctgtgctggctggagaacaactgaacacatccccccattctcccttccctgcactggggtgcagccttcctgcagcaagtttcagaggtggaaggctgatgataagtctggagctgacaggcctccctcaagggaggacactttagcagagagatttgcacatttctagaggctgcaagagggcagtgctcagcttgatttagagccaagaagtaagaaagcaggaggaaggtgaaatgaattgcaggagtgtgacacaaaggaggctggagatgccttttcttacataggcccagcctcactttcagcccaccttcaacccagcttcagccagttttgtaaggtttggaactgcacaagagagaaataaaagttatatgaatgtgaatggtttccaaaagtctctctgcagaacctcttaactttaggtgcagataaactgcaactttcttcaatgggttcttggacccctagtcatggtgacagtttgactagcattgagagaatgttgaccagaaaaagtcaacatccctggcccttacaaaacattgaatttcatctaagtggagtaaatggtttaaaagtttaaaacatgtaatgaaatatatgtagcacgggcatgcatttcctttgctcccactctggggcagctgtgagatacttagagggaacatgctggaaggaatgtcttctgcccagtgtctgtcccactggaatgtgtggtaagtctccccaactctgtgggttgcagaaagaagaatgttgccttttcctcaattttggtgtgcatttcagatgttattgcgaaactaaagaaaaggggcaaaattcttctcttgtgcctatctctctccgtctcttccttcttttttttttcttgtcttggcatatctcagaattatccaagactttcatcctgttgattattccttagtcatgtatattcgatacattatgactctaaataaacattccatcttccttacgaactttgtaagaatggggggcagggggtgtccccccttgtattgttagatgtctagtacctcacacaggcctggcacagacaagatagtcactgtttgcatgggtggatggatggatgcatggtgggtcaatgggtgtgtggtggatggatggagggagagacggaagggagggatgatagattgaggagtgatggatggatggatgaatgatggatggatacatgacggatggatgaataaacaaataaatggagagatgggtggataaagataattcaaatacatacacagatacacaactggacaccatcattccccacacactcctaaagaggtgtgtgtcttctccccctgggtttcatcaataagcaggatccctcttaagggaccaattcctctggtaagggtctgcaagtcactcatctgtgtctggcaccttgcacagtgtgtgcagtggaagtccccagcaagtgtgtgttgaataaaggttgtgccatgcattagttcatggtctaagtccatataaaaagccaggtgtttggagttactgtagtatctgttgactttcacccaaaatctaaaaaagactcctcagcttttccttccagcatagcagaagctcttccaagatggccaggagataaactcaaaagcggtttcattcttccccatcctttacttttggatctgttccctggagcatggggaatgccgggtgtcttatttcttgaagctgaaatttcctgatattgtgtacagacccccacccgcctgtcccgcagggctgggtgccagagcaagattcaggaattggccatcaaatgagttcctcatttgcaatcaattaacagccacctggcctgttttcctgcctccctcctctccccttctctctctccccttgttttgcatcatgaactgattggagtgtgagaactggggccttaaccaggtttgcaacttctccctgccaggagcactttctcccaaaacctcagggctcccgcgtctactccttcaggccctttctcaccctcctgaatttaaaattgcaacccccaccgccttccaatccccttctggatatattttctctggagtacttacggtcttcactatactacgtacttttaatagtttattttgtgtatgtctctgtccccttataaagtgtatgctcccttaaggtagagatgtttttatctattttgtttctattttctttatctattttgttagttcctagaaccatgtctggcacatattaggtggccaataagtacttggtgactgattgaatgaatataatattaagatgattttttaaaagtctcgtgttcagatctttgccaggggcaccctgtcatgcccctggggtctcccctgaggagagacctctcaccagaggagctgcagtccactgcctctctggaggggtttgcctgcaccctcagcacctggccgatcctccgatgggtcttcctggtgctgtgactgtctgtgactagtcgtggatgccggctgagcctgggagcagcggttaccggaaatctgtggctttctgctttagctaaagagagaagactgcatgtgtttgccagtcttttgggtgcttctgtttagcatagacattggccaaggctgctggtaaagagcaccagagaggcgctttacccatgagagggaagcatctgcggcccggagccctctgcaagctgcctcatgggacccctaacagaccttcttgcctctctgagttcagggtagaaacaacctgctgatccgtctgtttccctctggcacgccaactctctcctgagagagctcctcctcctgattctgtgttctgagagttgcgcccaggggtgctgcacttgctccttccttctcagcctgtagctcagctctgacactcccgcgactcccccagcaccccgagcagggtgcaggtcttcctggacgggcttggggctgagtgcagcagaagcagcacaaggctcctttgctgcctctgcccctaaggagtcccaggatgtgtgaggaacagagctttctcctgtcccgagctccccgcagttcagccctctctggactagacagttctgcatttcttagctcactgtgctgtgctaaggaagccagggctgccccgtgggtggaacatcctctaatttgccaggcaggaaaggatggggcgatgagtcacccttctgagtgattcctgccgagcttcctacagaacatatccaggagcagccaccccgcccccagggttagtgtgtggaggcacaggtgctagtgtgggtggtgagaaataggactcggaatcaccctttttaacgtgcacagtatgttaattgtgtcctcacaaaagtgttgaagtgtttcttgccttatagaataaatggtcagaaaccagtggattcctttgagctgttttgatgggaggaaattaactgtgacagtgagaccttggtggtcccaacatcagcaggatgcagaagacagcctagcctgctgggtcatgtattcgtcttcggcagcctgggattgggaatgcgcgtgagtgcagagctgctcactgcctggtgccctgcagctccagtgctgcctcagtgcgttccaggagagacctcagtttccagccctagctcaagtcccagggttgatcttgctcgcggcagcaccaggcctgcacctcggaaaggcatgatggacttacctgtatctatcaggttcaggcattctcctgcctgtagttgagaattcaagttcagggtgattagtttcgccttttaaaagagccctagcatatccttgctggatatattcattgctgaaatgcacaagaaactgaatgtgatcaatgtaatgtattggtttcagcatcagatgttaagaaagtgaatctgttgagattcttgcttttaaaaacacaaaataaaacaagcctaaccttagtcagtcatcctggacttgagatcacatttcacagtctacaaagtgaggtttcacgtatagcataccccacctgtttgtgtaagtaaagttttattggaacacaatctcacccactaatttacatggaatctctggagctctggctgctacaatggcagagttgaatagttacagctaacactgatggcctgcaaagccaccttgctccactagagacaaagtttgctgaccgctggcatagaagataagagcacaaattctgaaaccaaactgctagagtttaaatcccagctctgccacgtattggcagcatgaccttgaacatgttaattaacctctgtgtgacttagtttcctccactgtaaaatggagataatatggagataataatatctccattataatattaataattataattatgatgatataataatgatatcaccaaaataatacttgtctcctaaggttgctatgaagttcagaagaattaataatgaggacatgctcagagtactttctgacaagtggtaatgtgttaaatttttaaggaagtgggcaggtttctaagactttaggaaagtccagtcgcttcctcaaatcacagacagttgtgcatttgaagatcacctcaaaaccaggttcagaggctcacgcctataatcccagcgctttgggaggccaaagtgggaggactgtttgagcccacaagttcagcctgggctgtaacatggtgagaccccgtccctacaaaaaaatagaaaaaattagccaggtgtggtggcatgcacctgtagtctcagctactcgaggggctgaggtgggaggattgcttgagcccaggaagtcaaggcttcagtgagccatgatcacaccactcgacttcagattgggtgacagttttttttttttcctttaaaaaaaaaaaaaaaaaaatcttaaaaaaaaataaagaccacctcatcatcagggtacctcccataggaaacacagccttgtgggtgtcttggcttcctgttggtccagaaccctgcggactttcctcgcaataagggcacagactggcttggctaaaggaagggtgctagtggtgccagccagcaggggaaccctcacccgctccggggatgccagggatggagtgaggcagccacagtgtccactgcgctgattccagcaggggatggcagcatggtgacaggaagtcacacttaataatgcagacaagagggaaaggagacccacagacacagggagaaaaagctgcaatatgcctcttcaactcatgagaacaggaggcgatgggccacagaggctgctgaaggagtttgttcctgcctctgtttttctctctccttctccaactagaatgttatgtgccacttgctcccctcagtagcacttccaggacaggtggactacatatttgtggaacccagtgtttttattgagaagccttctttttgctttttaggctggccttcctggaaaggttctgcttttaactctttgcgtgccttcccaggccatgcgtcctggtgcgaggctctgagaacgcgatttatgtcaccgcgttggcgacttacatgtgctccctgatcattgaagacacggttttgtctctgcctgggatcatggtggtcataccactccctgcttcaaaaccgaacatttcgtgttttcggagcagattcgtcaggacgttttgcagcatcctggggtgttacctgttccttgcgcctgatctagagttccgaggcctacgcacctcagaggagcagctgtggggactgtggggcaaggcccctcgcccgtcccacacgagaacggctctttctagcatgttttctcaggtgtctctttatcctctccctatgcctcaagtttccacattgaaaactctcaatggcgtttatttccttctgagtctctgctgggctgttccagcccttccacagcccctaccctgggaagcccgtacctcttccacacgccacctcctctctgcccctcagggctgggacatgctcgtcgactagccctcgctcatccacgtgtccctcagttaccttctcgatgatgacgttctaagatttcaccctatccccatcccagtgttcatgtcccctcccctggtttatgtgtccccttagcacttaaccactttctgacattctctagattttacttatttgtatgttttgttgctgtccccctggctggaacataaactccacccgggtggggacctctgagtgttttgttcactcccaaaccccacgccagaaccgcaccccacaagtaacgggcactcattccgatttgctgactaactgcataaatgtcctaaaaccacttcctaccttacgcggctgtagagaggataagaatgaaagttaaataaagcctatgaaaatgcttagaaaacttgaaagcataaagtgaatgtgaaagatgtatttatgaatgaagcagctcaacaaaaaaagacacttgggggctgggagtgggatatgtcggtgagactgatagcacgatgttgtcgagacattcgggctgatttaagtgactggcaacatctggaacccatcaggaaaagctttagcgtagaaggcattcctctccctacattttgaaaattcaggcaggcctagtaagctctttaatattttaggaagttcaaaaatatttaatatcttaaagaaagtcaaaaatacttactactctgggaagttcaaaaatcaccacgtgcctagaagctggcctgcaggagaaggattctccctcactggggaagaggtgtcatgctgggaaggctgtcttgttctctagactaggtaaaatgacaaccaaagacccatttttactttaaaatgagtttacaaagccacattaaagtgtgaaggcttcaagaaggaatttctcacagatagaacagaaaataactggattgactcactagcatgcaaaatacatttggaagggaagctgccaccaataagtttctcccttgggtacaaagaaatgtcctggtgtgcccacggctagcacgtgctgaggactcgctgtgaggccccgtgtaccccgcaggctgctcttgaaggaaccagtttccaagggaggaggatgatgccagccctgggcagtgtttccaccacgttgaggcaaatgctctttgcagcaaaccaggagagcatttgtttgtttctctgcagtgagactatttgcattaataacttacttatgaagtttaccttaagtctgtaaaagcaactgcaacatccaattttgtggagatttccattacaaagttggcaaagcgttttgtaactaaatatctggagttaaggatttatataaatcaacatggaaatggggtgccgagggaccctctcctgctccaaccgtatccgtcaacacctggtgcagtgaagaattctgctcagttcctcctgtcccagagcaaagggcagtctgcatccctgacagccagaccatcatcctctgtgggcagcaaattgcagaattagtgtaaagcagacaaatgcaatatctatgtgaaataagcccaaatcattaggtatgctttgattcaggcttaacattttttaacataatagcaaaccgtatttagtatcctaaatgtaaattcaggacttgtagttttcacatttttgtgttatgtatcttaaatgcctttctagagagggaggtacgaactggctcatagggtgattttttcctgagattggccacatgatttaaagatttgtaaaagcctttggacctatctgtattgagaggtaagagcttgggctcccttggtcctgggaccctctcctctccccacagcagggctgccgggagccctgggtgcagggtgcatcgggctgctggccccattgtggccctgctcccatctgtcctgtaacttctctgcatccaaggctaggtcctcctgtgtgtggtgtccttagcgccttgcactgtggccaccccctcgcatatggcgaaatgttttcctcaaatggtgataagggactgtgcaggcaagggcgggagtcctggaggcacccccggtcacaggatcaccctcagcgtttccaccctgcccaagaggtctgtggagcttccccgagcctttagcacatttgctaggaagtccatcctccattggtggaataaccttcctttttagaaccttcttgaatggctgtgccatatgctatcagcatatgccgtatgctaccaggtgggttatcttggtggtcaagtttgttttgctaaggtccccctttttttttgagacagggtttcactctgtcacccaaactggactgcagtggcataatcatagctcagtgcagcctcaacctgctgggctcaagtgatcctcccacctcagcctcccgagtagctgggactgcaggcatgcaccaccacgcctggctaatttttgtattttttttttgtagagatgggattttgccacgttaccccggctggtctggaactcctgagttcaagtgatctgcctgctgcggcctcccaaagtgttgggattacaggcgtgagccaccgcgcccaggctccttctgtttttgatggagcttgccagtctgtgtgtcatgtgatgtggagaactttagtaaacacgctgtgtgctgctgtctggtagcttcccgagtcggaagttatttgctaccaacaggagaccatcctttggtacttacagtgtgccaggcactgttaggagtaactcatctgtattaactcattcgatctcacatttaggatccctgtgagacagatacttagcacgcttgttttgcaggtacggaaactgaggcatggagcaggcagggtgtggcagaattgagctcttctgcaagaagcttcatggccaccctcaaaactccttgagcgctggggacccagttctaacacaggcctccttccttttgtcatttgagccagattcttagggaaactttttttttttttacatgctcacagatactttattttttcttacctttttgtattacacttgacccttgaacaatgcaggagttagggcaacaacccccggcacagtcaaaaacctgtgtgtaactttttatttttattttttgagacagaacctcactctgttgcccagactggaatgcagtggtacgatcttggctcactgcaacctctgcctcccgagttcaggcagttctcctgcctcagcctcacaagtagctgtgactacaggcatgcgccaccacgcccgactaatttgtgtatttttagtagagatggagtttcaccatgttggccaggctggtctcgaactcttgacctcaggtgatccacccgcctcggcctcccaaagtgtgtgagccattgcgccaagtcttgcatgtaacttttgactccctcaaactcaactcctaagagcttactgttgaccagaagccttactgataacacaaacagttgatcaacacatatcttgggagaactatacattatatactgtgttcttagaataaagcgagctagagaaaagaaattgttatttaaaaaattgtaaggaagagaaaatgtatttactactcattaagtggaagtggatcatcataaaggtctacatcttcatcatcttcacgttgtgtgggctgaacaggaggaggggttggctttgctgtctcaggcagagaagaggtagaggaggtggacgggtaggcagagaagggaggcacactcggtataacttttattgaaaaaaatccacgtataagtagacccttgcagtttaaacccatgttggttcaagggtcagctgttttttgggggggtggggggtaacatgaaagtaatgacatgaaaaatgtatatatagtaagatgatgtggtggttggtttgggttgaaataaggacctacaaggaatcctctgcctttagtcccctccttctcttccctcctgtcctcttggtcttctgcggtggctggagatccaggtccccagtgcaaggccccattgacctgaggccacccacaaaggaggcccacgtgagtgtgctgcccaaaaggccggtggaaaggtggtagatggggccgaccaggcatcagctggattcaggccctggagggtgcctgggtggggctgcaggggttgccggtagcgaggcctttgttccctgggagggatcaaggagcacttttcaaggtgcctggtggctgctggggacttgctcaagtactcctctaagtacccattatcagaacatgcctgggaacactgcaaataccagctcacagcatgggatctcttcccagaaagtgaggaagtgagcaatgcatctctgaattggataaatgtaaacagatctggaccctcctggcccaacggatgactgacccacagctgccctttcccttccataattaaacagataattatcagggctccacagaggcttccctcgccttttgggggagtgaggaggaggcaggtggttggaagctggttgcccagttacacgctttgtgatgctgaggaatttgcccaccttgctacatttttctcacttataaaaggactataattcttatttcacaggagtcctgtgagcagtaatcgggttatcgggagtgtctggtggggagtagcagctaaataatggctgagttactttgagggggtgatgtgtgtagctggcagtgcacaggttgggaggtcagaccacctggatccagtcctgtctctcggaccttggacaagttactggacctcactgtgctccaatttcctatcggtaaagtgcagataatataaggccaagctcacagggttgctgtaaggatcctgtgggtctcgcaggtagaggtaggagcagcaggcacacaggaggtgctcaggacaggaaggggcaaggtctggatgagagccccagtactgctggaacccagagaagcacatacctcaaccctgagggtgagagaaggtttacacccaaggaccatgcattggttctttgctgaattcacttattcagtgaatatgggcagatgctggaggggcggtcctcagttctcccatctgacttttgctgcagtgcatgaggagggatcaccactgaccacttcctacacttagaagcatctgcctttcctggccccggcacccagggtcctggaacatctgtttgcctcagcaagtagtcaatgatcattgtttttatagctcctttttcattaagagacacaaagctcttttcgtatcatcagttttattctcagcatactaagaagcacggaagggcagatttgattatctctgctttatgggaaaactaagcccaaggtactttgtcaaaaggtgcattctaaggccaccacagatgacctaaccgctgctttgatgcaacagggaaacaggccacaacaaagtctgggaaaagtaaaaaaaggaagaaaaaaaaaatttgcttttaaatcctctccaatctggctgcaacatgaaaatgctacaggcagctcttagctgtagacaatttatgtcttcacagttgcatccacgcaacagcttagtagtggcctcgtcaccctgtgtttgaagggcaagtcgtgttttcatcctttgtcttatttcatcaattcttcatcaattcttggatgaatgagtgtgcaaatatgggaaaggaagaaactgacagaagaaaagaggggacaaaacaaaaagtttggacccaacaagcagctttgaatgagaaaaagggacaaaggaactcgaaatataattatctgtaaaacaaaaacctgggaacctctggttgcagtgtgataacagtaacaaacttcttcatcgcggattaaatctataaagtggaagatgggatacactctggtaaatgcattatttaaaataaggtaaggccaagagttgtgccttttctaaatctgagagtctctgagttgaaagtgcttttcaaagatgacagcacataaatgataaccctcaacagtgctatgaaagtcagtgccttggcttgaaaaatgcttacgagctaaagaaattgtaaatacacctgagacttcctgagtgagtcagaatataagctgagctgtgaatgagatcccaaaatgtgttggctcagataagatcaagtttcctttttcttacttcatggtatgggggtgtgttctgcaaggtcaccccaagacccaggtttcttccccctttgctctgggcataatatttgatggaaaaactggcccaccctactgtgtctaccatgcagcccgtgggaaggcagatttccttatgcatgtcatcataaaacatgctccagaatgtgcaggaatcactttcacttgcattctgtggacagaaatgtggacacctacccagggctgcctgcaggcaaggctggaaaatgaaggcttctgctggaagcttgatctcagttgaaatttggaatattctgacagacaaaagaagcagaaagtgggtatcaggggtcattagctgtctctgacccattctcagaccccgcagtgcttggtgtgtatacaattagggtctcacccgccggggcctatggacgaatgtgttcatcttcctgacacttttctgctggccacatgctgtgctatacaggtctggagactgcaggtgggcagactctgtgtccatctataactctgggcctttgcatgggctgagcccctggctggaatgccccacttctcatcagccatacctgggattttccccattccgccaggcccagctgctattagcaataggatcttgggcaacatggactgtgaatctcatattttgggaaaaataatgggccaaatagaggctgtgagccaaggccccagtcccaggggactggtttgctagtctgtgtgttcattcgttcagtagatatatggagcgtatgatctgtgtcaggccagcagcggagcatccaacagtgagcaaaacaggcgagaatctgtcctgatgggctaattgtgaagggggccctccattgaaagcaggtggtgagagccgtgacaagtgctctccttgaaagattgcatccttagggtcttaaacacagggagccggtgctccacgctctccaccccagcttgctgggaggtctggaataggccagttggggttgtgccctcccgacgctgcaggccgactctggcacccgcccttactcaggggtacggcttgcctgagagtcccaaccaggggtgtcaggagcacattcattagagcctgctgccacatgcctgattccagtagaagccggagatggcgccgttgtgcccacgtgagcgccatctccacgggtaggacattaagtccagaggaagatgtgtgtgccacatctgagtaatgagccatgaaattgacattataagttttaattattattaatgccttgcaggggtggctgatgttaattgtcctgtaggcatcccagatgggttttccttttttcttttatttctttttcttaatgtcttgagcccaaataatggcggcttagtgacaatgtttgaatggaattcctctgaaggggagcacgccgcagtgtgagaagttcttccaaacacgtctgtgggcagaaagcaaacaggctctggagcagctgcccaccctcctgggtgggtgtggaggctgggacatagaggcctccaggttgctgccgtgaaatcagcagaagtcttttctcccccataatagcatctgcctgccttaggccccttccatggactaattagttaatcttataaagggctttgaagatgaaagactctggaggtgccgggtgtcacccatgtgagcatttcctgatgagatccagtttctggctgcttctgctcctccaaataaactgcctctcggcatcttccttgactcttttttttttctttccctcagaaatgtgtcctgcatcttaaaaaggttcattccccctcttggttttgctctgtccaatctgagtctggcagtctgagatggggatacagggggctctcttgccttctctctcccaccttctctgtcccctacccttccccacttctcctcctggctcaccagccagcaaggcaaacaggccccacctgagcccccatgctctcacagcttgcttgctccgagaatcatgctctcagtaccagactcgagcccagcaggtgggttggggccagcaggtgggttaccacctgtggagaggtggccaggcgtacaatctccagtctgcccctgcttctgccctgctcctgccctggtttccttttttttttttttcttagacacaggttcttgccctgtcacctaggctggagtgcagtggtacgatcattgctcactgcagcctcgaactcccaggctcactcagttttcttgcctcagcctcccaatagctgagactacaggtacttgccaccatgcctatttttaaaaaatattatttttagagatagggtctcagcgtgttgcccaggctagccttaaactcctggcctcaagtgattttccatcctcagcctcccaaagtgctaagataataggcgtgagccaccatacccgtccccagatccttcttttgtaactttcccccctgtatccccatccaggcctgactcaggactaacctgagtgcctttgaattaacagcatatagaggggacctgctacgcagggagaacactcctgggtcctggggtcatcagagtgaacagcatagtctcttcctgggggccttagtggcgtagaagctaaggaattaggaaggtggccgatggagttaggatggctggtgagtggctgatgggtgctgatggaattaggagggcacaggtggtgacgggggagcagtgtggattttggagggagtgagaagggcagaggaagtagcatggagctctgtctgcaaagccctgcatgttccaggttccagaagcacagacttctcgtgactgaggatgctgtctgccgtggctgggcaggtatgctgaggccagcgtaggggacctcggctgccgtgccgaggagctcggatcccctgaggtcatcaggcagacactgaagctcataagcagcaggtgcatgagcttggccctgcatttgggcatccagcccatgacaggctgatgggccaggagaccactggaggaggtttgcactgggtgcaaggagagatgacaggcaaggcagtgggagtgggagggtgcacagccctctgggtgaaagctcagaagtggagttggcaggaggagtgcccaggccaagggaaagggtgggcacagggatgactgaaggtccttgccgagcagctgagtggggatttcatggccagaggaggtagggctggagggacagacagcctctaggagcttgcagatgtccagcagagccgtcaagcaggcatctgggttcacatcaagtcccatgatcagaggggacatcacaggcacaggttgatttgagagccactggcacagaggcaggtttagctggggtctgcatcagtgaaggggggtgtcagggaggcctgcaggccacagtgctgataccagtgaggccatggtccctctggagaattcatgaaagacagaatccccgtgactcaggagtgtgtgtctcgcagtgtctctgtcctgggtggtggcctacagccccaggctgcctggtggaagatgcctcagtctctctggctctgcaccccagctttacctgccacactacctaagttggggccgcagttacacaatgtgggtgtgagtggtgtcttcaggtggcctttatgtcaaccagtctagagaaggctgatggtggggaggccagaaaggaaacacagtgtccccttctcgggggcattgcagggagatgtgtgtgctcagatagcacgagccggccgcagaagggagtgcagcgtgtaggcaggtgcaaagctggcccttcctgcccactgttgttaccaatggtagcaaaagtcgccaaacagccaccgagtctgtagctcttataacacggcttttaagcctcacccttgtggtttgggaatgaagggaaatggagtcattccctgacagataaaggttttttgtgtgcatcttgttgaggctggtttttcaacttcagagcatgttcttttcttacatcccttcaaaactgctcgccttgatggatatctaagtgtctccatgtagccaatagtgaaaatactcccctcatgaaaataaatgttatatttaacttttaaagtattcgtagactaagttctattagaacagggaaccttactctgtcttttttgtaaatttaaccaaacaggctgggccagggtttcttaacctgctgatggctctgggccaggtcattctttgtggcagaggctgtcctgggcattgcagggtgtttggcagtgtccctggtctttacttgttacatgttggtagcaccccaccttccggttgtgatagccaaaaaatatcttcagaccaaattgtcccaaattaagattccctggctggcggctgagtggcccctgtgtggcagtggaattattctgatggcctgcagccaactgccccttcccattttttctgatcacagtgcttgtcttgcaaattaccccttgcctccgctctctaaaattggggctcgttacacactattgtgctcgcactacaaagctatccagaatgagtattattggaagcaaacggattttttttttctcttcgagttctgcaatgaaaaatcctctggtgttactgtttaattggttagtggtggctgtttgtcaatttgccagcaggctctctcttaactgctgtcgtttgacgttgctgaaacataaatgtagaatgattgagttgccaacatgctattaagtcctctacaaagagtttttcgatgtactactgcttcaggcttttgtgcttctattgattgattcgaatactgaagaactccttggcataggcagccctggtgagaaaatgcggcttctggtaggaaaatcgttgggtattgacacccgaacaatgcaaagctttcctttggttttcctctagcacaggattgacctctggcaaagctcccacagttgagcaggtattggccacccataaaggaaaaggagagaggcccatgaggccagatggacttgatgagacagggccagttagagaagcccaggaagtggaagaagacatcacatcagtttccggattctttgacaggctccttattgctgacaagcagaagcagcttagaatcttgtttggatttcagagctagtcacggtttgagaccgaggatggcagaacaggtgcagatgggttggttaacctctgacggatacaagaacatcactgttaggaggatacagtcttatgcccttgaacaattgtacttctggaacagactgctacaagtacatgcagcagaaagctgtgtgtcatggtgggggggtctgtgatggccggggactgcttgttagaacccctgctcctgggcatggcccctgtgctccacacaggctgtttgtcatcatcctcgtgtgtgtaccgctggccatgagtcctctgagtggaacgctcagcacgacggatgccatgcacgcctgctgctcagcttcaacccctggagcatgctcgagttgctgtgactattcagtagatgaagtaaagaaaaaatggttggatacttgctagaagtctggcagcttcttagactaaaatccctgagaaataggagccagtggaaaatgattcagcatagagtattgagtaagaaattccgagcccagacctcctgggttcagattctacctactgctcctaggtgtgggccttaggaaagtcaccttccctctctgtgcctcagtgtccccatctgtaaatgaagacaagccagcacctacttcagagtcctttttgcacagaatgaggttgtctgtgtggaaggcctcagacagtgtcctttttaggaggaatggctaggatggggaccctcttatctcagtggcgcctcagaatgtgcatgttcctgtgacaggctgtttctttaaaatattttccacttgcggggcactctgtatgcacccccaggacacagaaagcccctgagaagccccggcctgccccggcagatccactgtggggcattgggaaggggcatgcccggtgaccacatgctgtctgttgcttgcagaatccctgcctgcttccctatggcaaggccctctacagctacgaggggaaggaacctggtgacctcaagttcaacaagggggacatcatcgtcctgcggcgcaaggtggatgaacagtggtaccacggcgagctgcacggcacacagggcttcctcccagccagctatatccagtgcatccagcccttgccacacgccccgccccagggaaaagcactttatgatttcgagatgaaggacaaagaccaagacaaggactgtctgaccttcaccaaggtaaggtgagccccggggtgggccccgccagcccatgcagcctctgtgccacccagggctcttcccagccacagacctatagccagacagtctttcttcagagtctgaatcctggctcctcccggaaccctgggcaaatgacccagcctccctccctgtgcttccatgaatggggtgatggttttttttggttgaatgctatggagggcaccagcttgacacacagctccagcccagagctacataggagcttgagataatataagcctccatcagcaccaggagcagaaccctcagttaacctgagtcatggctctaagcgctgacccaggtgcagcagaatgacgcctttccaggactcttggggtcctgtgagaggggctcatcaggggaaactgctacagagaccctggtcagctcacagggagatgatagctggggtctcacatctgtgcatcacagccctgtcctctagggcacctgaggcagggccaccctggtgcgtagggatccctgtgaagcaaacatttgggagcaaacaaaatagcactgacaggtgaaattgagtaggagggttgggtgaggtgcagaagagactggttctggctgtcctggcagttgctgttgaataatcatctgcaccaagtgctcggccaataagctcacacttggtctttacagctgtcccaggttccaggggaagtagttggaacctcgttttctccatgtgtaaaccaaagctctgagaggctttgtaacttatccaggctgcttgctgggtcctctctccctcctgcttccccttcctcctttccatcttcatctcctgtctcttgtgtctcctccatcccctgccactgctgcacctgctccccgccgcccccagatgtaaatgacagagccagaatcctaatgcagatctctgatgttaacactcagcattcttcccacctccctacacagggaattcttcccttatgtcggcctcactgtattttagatgcccagaagttgttgttttctctctcctcactcgttctgtcttgcctgtgtctctctgtgtcagtatttctctctctctctctctcacacacacacgcacagagttgtaaataacagaactagaattctaactcgaatctctgcttctaaagcccacatccttcctgcctctgagaggccattgctctctcccccatctgctgagtgcagagctcgaggtggcactctctggagggcggtaggagaaccatgcacagtgtttttgagcaaaattggcatgtcctgcgtacagctgctatttatgtcttgttctattgttcagcctgacaatgaataatctatttttcattcagggattcaactccttctcccttccttttatcaaggtgttctgatgctaattccgattgtcatctggctgcacagcttcccgggaaactgcactggtgcctccctccctccccactcagtcggagggcgagagcaacagcttcctggggctatttttaggcacacagaaacccaacttgcttctctgcccagtggactcttccccctaagagaagacctgggaccactggtgccccaggtggtcactcatgaccaagagcagggacctctgaactctcagggtccggtcagggccttgctaaggagacagaccccataatggctctaggcttctccaggcttggcgggctccaggctgcagagccgaggccctcctccaggggcctcacaggaggaggctctccactcgggagaacccactgtgaacgggctgtcgcagggccctggagcctctgggtaggcctgcttctctgggcagaagtgactgcctgcctttcctgtcatcaccatataacctgctgcattccacgggcctctgcccaggatgtgcaaccccaggctgaaggctagagcccactggacaagaggacaaagggcacctgcccatttattccacagaaacataccgggccctgactctgtgtcgggtactagacctgctgctcttctggagcccagagtcaggtgcgggagacaggccagtggagaatgtgcagaagacaggccagaggctcacgagctgcatcggatcaccaggggcaggccgggcatttagtgtgggctcctgagtagtcagtgatggaattccatgttccatatttcacaagaaacagtgaaattagagccatcaggcttagactcattctgcggttggcatgtggggtgggggtagccgagcaggggtccatctgttcccaagtgggcaatgtcaccatggctgcccaggctctctggaaggtgacctcttggttgaattgaggtcagaggcgccagccacgggaggcccagcatctcctgttacaggatctgtgacggctcccacagcagacaagggggaagtgtcatatcacagattctttgttcaaggactttctttacttgaatcctgtgagttaatgtggagaattagaggcctctgggtgtgatccccagagggacttgtgctgtgacacgaccttcctgccatgctcctatgcccactttgaccctctgacccccaaagggcgaggtcgggcagagattggccacccctgctacctgttctgtcctgttgcatctctcactcctcagtgtccgcaaataaaggctccaagagacatgggcaactccatgtgactctccgctcagttcctgttttcccccacggtgggtccgacccaccttacttcccccatgcctggcatgcagctgagacgcacacactggctctgacaacctccatgtgaatcagacctccaggaaccaaatgattccagtgctgcagcgtaggtgctggttcatgccagcttggtctcccctctggggaatgtttttattctttggatatgttccattcctgagtcagagaggaaagaagggtctctgaaagctacaatggtataacctgcctttatacagcatcactgtggcagactgatggagtttaaattaggtggatcaaagcaagatttttacctttggtgtttgcttttgaatagtcctgttaaagtggcattaattaaagtccttctaaaatctagtttctgctttatttcagaagagaatgaataatcagtttttgtaaagcagctttaaaaagtgatattttattacttcttagtagcccgactccagaaagctgggcatgtgcaaataaaaagacgacaggcaggaagagctgtgggcccagctctgccagctggtttctgaggagcctccacacgtgctgggccagtcacccgggaggggctggccttggcagggccttgcagtgagggccccatgccagctgtgtgacttagggtgacacataacctttctgggccaggagcacctcgccttcccagtctcaggatgccagtgtgcactctgtggtgtgctgagaaccacatgatataaataaattgtggagcctagggctgggagtgcaggagaagaatgtgaactactccattgtttgagcagctaactctatattgtcttactcagctcacctgcaagattcggcaagggtttattgaacctcttctctgtaactttcagttaatgaaaacattgtggtcgccttgccaggcagctgcatttgctatgcagggcccacgctgcttttcatgagttccagctgggatgctcaggaatcctcagaggccacggggttttctcagagagtgcccgctgatcatggaatcacttttgcacatgactgcagcggggcccccaggcttgccatatcagccctaatccctaccaggtgtgccatgtgaaggagccacagggcttggtggctgcagccactgtgctgtcctaaccctcatctcaccctcgatttgtcctgatctggtcagaccttaagactcttccatgtgaccttcttatgctgctgaatgtttaatcatttctcaaaagtatgggaagtcttacctttgtgaattaacctagcattaattccaaactctgctcctctgatcctagggacagacatagatggataaaaatcaaatatagagttcaggctctagcatgaggtagacacagattcaaatcatggcacgtttctttaataatgcatggtgactcgaacatttacttagtgtttgagttgctttttttaactttaaatggagttgatattaggattacatgagcaaaggcattttaaaacccaagctcaaaataggcattccaataaatatttgctgtctgccctctcctttcttcctgtctcaggaaaagttgcacttccgtcagatggtacatatcactttttatgttagcccagaatactcgcaggaaagtaagcctccctcctaaagacagactgcatggagaatgagaacttgcaggactggtctgctatgcttttactttcctggtggctaaatctcagagaggattgcctgggggtagcggagctgagccccttgtgtggaggccacggtcccctcaccagcagagccaggcgatgggcaagcttccaaatttgcagtgtcgtctctgcttcttcctgactgagaattgggatgactttgggggccgagacgatgaggaaactttagctttacctctttttgtatcatgagataagcttgtgcggagctccacgtcgttctctcccttcctgggcaccccgcttgggctactttaccctgaagttacccgagaaactcagggaaccagttctcctttttggctccttgcttcgtggatttctcctcctaggctcagtgcacctgcagccacctctgtgcacaatgatgcctcccacgaaggaggctcaactcgcagggcacggggcagaggggagcagagcaccctcttagccactacagaccaccctcgcccagccccttctgacagcaaagggagtttggataaactgcacagataaccgttttgatttgcaggcaaagcttgggctgtatctgaagctttgccagaaattttcagaacctacacagaatgtgagctcctctccatgggcacgcctggctcctgggagcagtcctggccctggccgctgcagctgccccacctgctctccactgggtgccagatccacctctcaaatctgtgccacatggagcctctgctcagagtcctcagtggctctccacctgtcccggagtcatggcaaagttggtgctgcccacaaggccccacctcacccagtccttgctccctcaagggcctgatccacttctggcccccggctcattgcctgcccagctgcactggcctcctggtgggttctccctgcagccgagcccactgcctccctgggcctgcatggctgccttccttagcctgggtgcccccacacatttatagctcgaccctcgtcctcagcaaatctctgctggaggtgggggctaccctctcccgctgtgggagggagcaccccacactgagactccctgtccacaccctttctcctgagaggtaggtgttcatagtcacgtgacaccgcctgcctgagggtgggttgagaccccaccaccgcctggccccaacatagggcagcaaggggcgcctggagggacgtggagggaagccctaacagtggagtggggtgccctgtgtcacctggccagggctggcaggcctgctgggtgagagtgcctctgtctcctcacccaggcttcttggtccattccttcactcttcagatgtttatcaaccctagactgcgtgcccaatgccagggatgctgtggagtgcactgcccttaggcactcagaacccaaagacgtggagacaagacgagagagtctcccctgcccgtgtgtgcatgcgtgtgtccgtgtgcagtgggagctgccggcagtgagagggtgtgatctctgacatctcttccacctgtggccgcaggttcccctcagccctcagaccccctgaggggcccctgcctccctctggagttcagatacgtgaacacgatgggaacaccagaggaagcccctagatgctctggaaagtcagagccccccgaagtctcagtgacagcaggacaaagatgcagggccagcccgctaggtgggggagctgatggtggctaacagttccataagtgccccaccatagatggcagtcggctgtcagaggcacagttttgggttatttctgcaccaaaaggctgagggagtttctgaactattccctttttaattttcccttctccctgcgacacagagtgggttgggccctgtgtgtgtggctgacctgtgtgccgccaacggatactgcctgtgtcaggctgggtcactgcggtggagcaggcagcccatcaccctgcaggcccagaggctgaagggggcccggcagggtcaggggccttctctgggctccagcttgttattgcttctaggaaaccactcgactgcatgtgagccagaaaagtggcgcagcgttcatgtggcctccaggagagcagggctgtgggccactcatggccaggcagggactgcttctggcattttacatgtgattcttccacacagttgacttaggagagggaaatcttaggcactggatgtgggtttatccagagctgctgagggagctctccaaggttttcagtgatcgtggcatttcatgctgagctcccaaatgcctgatatgtgagctgcgatatttgccaagatgtgcctttgtagtggtgtcaaagggcagtgtgctccgccagccacctccagtggcatcctaaagggacagggaaggcgagcgtcggcaccctgccccgcagcctctgttcttcacaaaggcgcatctgtgtctgtggctttccttctccccaggtggaagtgaaaacacagactttggaagagctagtaaatgagtttaaaatgcactttaaagactccttgtagatggcaggtcctaccatgtcacctgaatcctttgtgaatgtagtatttacgaagcttaggaagaaaggtgatatagttttttagtaaccactttatgttcatagctcaggcttacacttaggaagaaaggtgatatagtttttagtaaccactttatgttcacagctcaggcttacaatcctttaggaccaccctgagaccacctgaatacaaaggagagccactgccatatggtaacggcatttggtgtattttcaaaacttggaaataccagggaatagggaaaacagcatatgaaagtctacgggcccacagtgagtaatgagcacttgacatgaaacctgtaaacgaaattgagctttgtatctgaaagagaaattatgttgtggaaacaagtttcattcataaaattcttgaatgctggcatattggcccaggaacttgtctgcttcatctgactcttggtgatgcctgtggtttctggtttggtttagttcactcatctacatcaagcaagggttggtggactaggactctctgaccaaatcctgcctgccaactgtttttgtaaataaagttttattggtacacagccataattcatgtatgcataactgctgtcatgctacaatggagggttgagtaattgacctacaactcctgaaatagtctctggctctttctagaaaacgttcctgacctgtgacatagagcacagcactatcagggccaagggcacaggtgttgtccctgtatgctcccttcagcgtggctttcctcttcggccattgggagcctctggtattgagtgtgcatctgttgggaaacagtgagtggagaccctggggacgccctcctctgtgaagcagcaacttaacacgcaggtccatgccatgcggatcagtcttgccgtcttcatatacaaagcccatttggtgttttgaggaggggtatttctccatatactaatgagtctgtgaagcagctatttcctccttccttgtccttctgaaagcaatggctccaggtttttgtaacatgaggacaaatcagagtcctgttgtgatctagccatgaaaagttgccattgtttccctggtcctgcattgggggtggagaatcattattgtttccagaacacaccagatttatgctggtagccctaacatgctacagtgaatgttttcattgcccagcactcaaacattcctctttggaggttgtaattattgtgggagtttgggttagaggcagagctggggaaaccttccttgacattcttagagttaattatggatttttaggtacagggagtggctgacttcctgcaccccagtattttcccagcccagcctctacaccaaaatgactgccaactaaataggaacattctagatcccaccgccctcctgaggtcccacacagccacagaaaccagaatttcccacattgatatttgagccagaagagatgcctgctgccaggtgccaccacactgcagctaggtctatgttggacttgcctctctagccagatggagccatggcagggtccactgctcattcactaatctcacagtagcacgacactcgacatgcttgggttttagatgccacatatggcagcctggtggggttttcatgtgctttctcaataccagatgctgaccttctctttaccacaggccccctcctcctccttgggaggggatagtttcttcctcagccaaaggcccatcccagggcttggcacttaggagatgcttgaatatattggtgacgtgatgaggagcaacctgaccctgctgaacactagtagtgatggccaactcctggcctgtgaagtacacccatctttggacagccctgcctcacagggagcctgcccacattgcagtaacatggggtccttggtgcaaatcccaccctcctgggtgactgaaaataagcctggttcttcagcatggtaatgatgtcaaagcttaaagacatgatcacggcccccacagcgctctcacttcccaggctgagccatcccacctccttccctggcttgccatgactcggttctggactgttccgtgatggtccacttctgcagcacagatgtcctgtagagacatgctagcactgaatgcaacattcaaggcatgctgctgcttgtccatactggatagactgttacctttttaaaatttttttttattatgttatatataatatatatttaatacttatacataacatatcagaaagttcactaatcataattatgcagcttgatgattatcacaaacaatatattcttgttttttgttttttggttttttttttgagacggagtcttactctgtcgcccaggctggagtgcagtggcacgatctcggcttgctgcaagctccgcctcccaggctcatgccattctcctgcctcagcctcccgagtagctgggactacaggcacccaccaccatgcccggataattttgtgtatttttagtagagacgaggtttcaccgtgttagccaggatggtctcgatctcctgacctcgtgatccacccacctcggcctcccaaagtgctgggattacaggcgtgagccaccgcacccggccaacagaatatattcttacctagtgatgaaatgatggatactggggctcctgtgcctctgacagttaccagcccgcccttcccgcatgtctactaacactacagatgagttgtgtttgctcttgaccttcacatcaaggaatcacgcaggatttatttttgtgtccaactttgttttctctcagttttatatttgtgagctatacccatgttgttgtagggcactgtagtttgctcattttcattgctctgtggtgctattttagatttttaaaaaataggtgttatatttttagagccgttgtaagttcacagcaaaattgagcagaagatacagagatttcccataaacctctgcccctacatgcaaagcctcctgcattgtcaacatcactcaccagagttagtgcatttgttacaatcaatgagcctatattgacaaatcgttattactctaagcctatagtcactcttggtgcagagtctactgatggagatgtcatgtatctaccattataggcccatacaaagtaggttcactgccctgaaaatcctctgacctgtctatccatccctccctcctccaccacccctggcaaccactgacctttgtactgtcttcatagtttttcctttcccagaacgtcatacggttgaaatcatacaatatgtagccttttcgtaatggttgccttcacttagcaatttgcatttaaggtccttccatgtcttttcatagcttaatagctcatttccttttttatcattgagtaatatgccattatctggatgtaccacagtttgtttatccattcacctactaaacgacatcttggttacttccatgtttgggtaattataaataaagccactctaaacatccatatgcaggtttttgtgtggacataagctttcagctcctttggataaatactaaggagtgtgattactagtttgcatggtaaaagcatgcctagttttgtaagaaatttccaaactgtgttccaaagttgctgggccattttgcatttctgccagccgtgaatgagcgttcctgttgctccacatcctcatcaacacactacacactacactgtcttctttggtgaagtgtcttctttggtgaaggtctttgactcaccattcaatcagactgttttcttgttgttgagttttaagagttttttgtgtattttgcataataatcctttatcatagttgtcttttgataatattttctcccagtctgtagcgtgtcttctcattaccttgacagtatcttttgcagagtacaaattactaattttaatgaagtctaacttatcaattctttcttttgtggatcatgcttttggtgctatatccaaaaagtcattgccaaacccaagatcatctagattttctcctacattatcttctaggagttttgtagttttatattttacatttaggtctgtgatctatattgagttcatttttgtgaggggtggaatgtttatttctagattttttgcatgtggatgtctagttttcctaccactgtttattttaaaaactatcttttctccattgtattgtctttgttcctttgtcaaagatcagctgactgtatttatgtgggtttatttctgggtgctctcttccattccattgatctagttgtctattgcattgccaatgacagactgtcttcattattgtaactttattttcagtctcgaagtcatgtagtgttggcccttgttcttctccttcaatatttgttggctcttctaggtctcttgcctctccatataaactttagaatcagttggtcaatattcacaaaagaacttgctgatactttgattgagattgtgttaaatctatacaacaagttgaaaagaactgacatcttgacaatattgagtcttcctatccatgaacatgaaatatctatttgtttagttctcctttgatttctttcatctgagatttttaattttccctatatacatcttgcacatattttgttacacttatacttaagtatttcatttgtacctaagtatttcatgataccatttacatttatacctaatgtaaattgtatcatgttttaacttaaatttcatttgtccattcctggtacaggttgagcatcactaatctggaaacttgaaatccagaatgctccaaaatccaaaattttttgagcaccaacatgatgctgcaagtggaatattccacacctgaccttatgtaatgggttgtagtcaaaatgaaggcacacaacacacagtttcttcagcatcctcaagggaaaaaagaccctcccaggccccttcagctgtgatatttattttccacacatgcccagattcccccatgcaagcacaaccataaagggtcataaaatggcacatgtgtaggctgcacatgccaatggcaggttctccacgtgaaaagagagatttctatgaccattgttgatgaggcagatgactgcagaaaaatatttttaaaagccatccagcagaatgtttcctcatccacagaggacccacttactggtcccttaaccacttctgatgtttccttgcaccaaaaaaaaaaaaaaaaaagtatacacttaccttttaatcaaagcacagcatcataggtagagactgaaagcctgccattgtttgttgttgctgttgtttaacagctgatacaggtattctggagaggctactgtgccgcttagttactctgaacatgtaatttttttcactgtattaataatatgtcatattttttactgctaaatacttatgtgtgaataattgtaagaaaatgattgcttattggtagcatataaatccagagtcagaagtgaggctgatgccaaacaaccacagatggtccgcatgggtgataccctttgctttttgtaggctcgatgtacacaaactttgtttcatgcacaaaattattaaaatgttgtataaaattaccttcaggttgtgtgtataaggtatatataaaacacaaatgaattttgtgtttagactggggtcccatacccaagatatctcattatgtatatgcaaatattccaaaatctgaaaacatctgaagtccaaaacacttttggtctcaagcatttcaaataaaagatactcagcctgtatataggaaagcaattgacttttgtatattagccttgtatcctgcaaccttgctataatcaagtattagttctagaagttcttcagttggttctttcagattttctaaatagatgatcatgtcatctgtaaacaaaggcagttttatttcttccctcccaatctgtacacttttaatttccttttcttgtcttattgtattatcaaatatttttagtatgatgttaaaaagcaggggcagagagtacattcttgccttgtccttgatcttagtgggaaagtttaaagtttcccaccattaagtttctcgtaattaggtgaactgtaggttatttgtagatgttctttatcaagttgaagaagttcccctctatttgtagtttactgagagtttttatcatgaatgggtattggattttgttaaaagctttttctgtatttactgatatgagcatgtgatttttcttctttagcctgtggatatgataggttacatttattgatttttagatgttgagccagccttgcatacctgggataaattccacttggctgtggtatataattctttttataccttgttggattaaattttctaatattttgttgaggatatttgcgtttatgttcatgagatatataggtctgtaattttcttgcaatggctttgtctgctttggtattagggtaacgttaacctcatagaagttaggaaatattctttctgcgaagtattgagattgtagagaattggtataatttcttcatttatatgtttggtagaattcactagtgaacctatctggtcctggttctttctgttttgaaagtttattagttgtttattcagtttctttttttaaaatggagtctcgctctgtcacccaggctggagtgcagtggcgcgatcttggctcattgcaacctccgcctccctggtccaagcaattctcctgcctcagcctcccaagtagctgggactacaggcatacgccaccatgcccggctaatttttttgtatttttagtagagatggggtttcaccatgttggtcaggctggtcttgaactcctgacttcaaataatctgcccacctcagcctcccaaagtgttattcagtttctttaatagataaaggcctattgaattatatatttcttcttgtatgagttttagcagattgtcttttaaggaattgttccatttcatctgggttatcaaatttgtggacatagcattattcataatattcttttatttttttaacatccatgggacatacagggatgccccctcttttattcctgatattagtactttgtgtcctctgtttttcttagtttgcttgctagaagcatatgatttttattgatctttttaaagattaatttattgatcttttttgtttcattgatttttctctattgttttcaatttcattgatttcttctatttcttttattttatttattatttgcatttaatttgctctttttttcctagtgtcctaaagtgaagatttagattatttattttagatcttccttcttttctaatcgatgcattcagtgctataaatttccctgtaggtgctacttttgcggcatctcacaaatgttggtaaattacatcttcatttttatttagttcaaaatattttttaaatttctcttgagagtttttctaagacccaagtgttacttggaagtatgttgttaaatctccaagtattttgggatttccagctatctttctattatggatgtctaatttaatgctattgtggcctgagagtagacattgtatgatttttatttgtttaaatttgttaaggtgtgttttgcagaccagaatatggtctgtcctggtgaatgttccctgtgggcttgaaaagaatgtgtaatctgctgttgttggttgagatattatgtggatgtcagttgtatccagtagattgatggtgccattaagtgctattaagttcagttatatccttactgattttctgcttgctgtctctgtccatttctgattcaggggtgttaaagtctccagctgtaatactggattcatctacttctccttctgtcagttttttgcatcatgtattttgacactgttgttaggtgcgtgtaatgataaggattattatgtcttcttggggaattgaccccttcgtcattatgtaatgcccctatttattctgataacttttctcactctgaagtctgttttgtctgaaattaatatggatatcttttgattagtgttagcatgttatctctttcttcattgatttgctgttaatctgcttgtgtgtgtatatttaaagtagatttcttgtaaacaacatatagttgtatcttgttttattttatcaacttaaaatttttaatttgtatatttacatcattaattttcaaagtgatgtgtgatagagtcaggttaaattctaccatatttgcattattttattatatttgttgcccttgttttttgttatttttcctgtctttcactctttttcggtcttttgtggtttttattgagcattttttattttctattttctctcctttattagcatatcagttgtacctctttttttacttttttaattggttgcattggagtctgcaatattcatttacaatgaattcaagcccactttcaaataactgtgctgctttgcaagcagtatgagtacttgtaataacaaaataatacttatttctccctcctgttccttgtatcattggtgtgattcatttctcttgtacatgagcattgtaagtgtatgtaaacacacacacataagcataaaatgatcaaatacattgtttttattttaaacagttatttgttaaatcaattaagaatagcaaaaataaaagttttaagtttactgccattccttctctggtgcgttgcctttctttctgtagatctgaatttctgacctatattatttttcttctctccaaagaactctttaaaaacagttcttgcaaggcacatctactggcaacacattcactcaattcttgtttgtttgacaaatctttattcatgcttcacttttgaaggataatttcacaggtacagaattctaggttggtaggttttttctgtcaacaccttaaatattttactccactctcttgcttgcattttcttttgaaaattcaaatgtaactcttttcctttgctcctttataggtaatgtgttttttcccctctgacttctttcaggattttttctttatcttttattttatgtagtttgaaagtgctataccaaggtgtcatttttctggcatctatcctgcttgttgttctctgagcttcctggatctgtggtttggtgtctgacaataatttggagaaattctcagttattattgtttcaaatattccttctgttcctttctatctttcttctccttctagtattcccattacatatgtataattgccccacaattcttgctttgaagttgtcctgcagttcttggatgctccattatggttttttttttttctaattttttttttctgtttgcttttccatggtggaggtttctattgagatatcctcaagctcagagagtctttcctcaactgtgtccagtctcctaataagcacgtcgaaggcattcttcatttctgctacagggtttttgattgctaacatttcttttctggctctttatctttgcttacatcacccatctgttcttacatgctgtctagttcaaacattaaagcccttagtatgtgaatcatagttgttttgtatccgtgatcttttaagtctaacattagttgccacatctcaatctggttctgatgcttgctctgtctcttcaaactgtggggttttttgcctttcagtatgtactgtgatattttcttgataccagacatggtggactgggtaaaaagaactgctgtaaataggcctttggtgctgtgggggccatgcggccacaaatgttctatagtcctgggatcaggtctcagtctttcagcaagcttgtgcccctggcctgtgaacttccccagtgcttctcagtttcccccactcctctgtaggtgaaacaggatggctacagtgggttgaagtttggtatttcccttgcccccagtaggtaaggctctcataaaaccccaatgggggccagatgtggtggctcacccctgtactctcagcactttgggaggccagtgcaggcagattacttgaggtcaggagttcgagaccagcctggccaacatggtgaaaccttgtctctactaaaaatgcaaaaattaactgggtgtagtggcacacgcttgtaatcccagctacttaggagactgaggcagaaggatcgtgagactctgtctcaaaaagaaacacagacacacacacacatataaaacaaacaaacaaacaaacaaacaaaacatcccaatgggtgaggctgtggttaactagtttatcctgtatgtggatcttattaagcacagaatgctctggcatgtttcacagtggttcctcttcccctccccctgccagaagcacgagtggatttttctctgatattcactatgaagacttagtggagctgctccttgaggcacaattcacaaaggtgtgggccccccagtgactgggcccctgcagttcttacctctcaggctgtccacactgaacctccagcacacatcagttacagttcaggccctcctagccgagcactgcttcccacggaggctgctgcttggggatttctggtatttccctattgatctcttcaatttggggggcagcagtttgccctgtgacctcagttctcttacagatctaagaagaggagttgctttttcagtttgttcagcttttttactcattgttaagatggagtggtgactttcagcttcttacgttctagactgggagccggacacccccctgttagctattgaatggtgtgtgtgctaatacacctttaacaaccaactcctaatgatagttactgtggcggttgtatttaactaaaagccacagacactgttttatttcattgatcttcttatcaaggaacatttatgttatttagtttttttgcctaaatggagaaatgtacaatttgcatgtatctgtggtcccggctgtcgactgtacttgtgaactatgatcctgccatcgcaggtatccatccctttcactgttaaattgcctggaaatcaactttctttacaaaagaaaagtatatttttgatatttggtttttcaacatttaaaaaaatttcagagtggaaatatacatgtcatttagaagcacaagaaaattacatgctgcttgctttcttcctgaatttgttttctggcatataagacaattctgttatgaaactattaaatacttggtattcactgagattatttgaaaaataggaaagaaaaaataaatataaaagtgttccacctcttctatctcctagagttatccattctttaaattttggcatatatattttcaaactttttctaggtatatatatatttaaactttcttaagcaaaaatagtaaaattaatgatgacattccactttatgggcaccatgcaaatgggtttgtatcttactttgcttttttcgtttaaaaataactatcaagtccactaagtaaattacagtaaattcatataatggaatgtctctgtgtagttagtgaggaagatctatatgtactgtcactaaatgatctttagactaaattaagtggaaaaaagcaagatacagaaaagtgtggtgagttcactaccatttatatctttctaaaaggcatgaatgtatgtgtgcatatatacgtttatgcacgtatacatatatacatacttgaggagaatatctctgtacttctctaaggctatataagaagctttatggctgggcatggtggttcatgcctgtaatcccagcactttaggaggctgaggtggaaggatcacttgagcccaggagtttgagaccagcctgggcagcatagtgagaccttgtctctacaaataataatcaacaaaattagctgcgtgtggtggcacacgcctgtggtcccagctactcaggaggctgaggagggaggaccacttgcgcctggaaagtcaaagctgcagtgagctgtgattgtgccactgcactccagcctgggcaacagagcaagacctcgtctcaaaaacaaataaataaataaacaaaaagaaacttattaatgattgctttgtggaaggtaagctgaaataccagcgatcaggactgggattcgttttttgaatttattttattttattttttgggacagagtctcattctcgcccaggctggagtggagtggcatgatcttggttcactgcaactttcacctcctggttcaagagattctcgtgcctcaccctccagagcagctaggattacaggcatatgccactgtgccctggtaattttttttttttttttttttttttagtagagacagggttttgccatgttggccagactggtctcgaactcctggcctcaagtgatctgcctacttcggcctaccaaagaactgggattacaggtgtgagccactgtgcccgtcttgttttctgaattttttactttttatttttatttttagatggagtcttgctcttgccacccaggctggagtgcagtggtacaatctcagcttactgcaacctctgcctcctgggttcaagcaattctcctgcctcagcctcacaagtagctgggactacaggcacacggcctcatgcctggctagttgttgtatttttaatagaaacggggtttcaccatgtcggccaggctagtcttgaactcctgacctcaggtgatccaccgacctcggcctcccaaagtgctgggattacaggcatgagccactgtgcctggcctgttttttgaatttaatattaacatttctcttttaatttccattatttctctcctgtatcatttttaatgactgagtgtattccattgaatgcacaatactgtaatttatttaaccagtccccttttgctttgcatttgtctctagtttttctctagtttaacaaacactgtaatgaatgtcttcagtaacaaatctttctgcacacttgatttttcttagaatagagttcctaggagtggctatttgtagctcagagggtgcacaggcttccaaggctttgatatttgataggaatcaccgaactgcctgccctacatttatatccccaccaaaaatgggaaagtgcctgttccatgcatactggccaccactgtgagttgggtttatgtttctcattgctaatttgacaggcaaaggaacaaaaggggaatcttcctgtttaaaactgtgtttgtttgaatattagccaggtatgccattttaaaatatgtttaatggaaatttgtttttcttctttcatgagttccctgatttttggccttggcctatttttctcttaaggtatttgtctgcctttccactgtttttttaagtctttatacagtaaagacattaagcctttgtctctcatgtatcctgcaagtatttttctgtttatttgcctttttgttttgtttctgttatttttaacattgagtatttagttttgctgtagccaaatctttgttatcataccttgaaatacattccccagttcaagattaaacatctattcatattttcttcttggacattcaagtttaatccttatggaatgaattttggcatatacagtggattagagaactaattttatttttttaatgattggccaattttagtaacattttctaactgattattgctggtatatgagaaagccaatgatttttatgtatttatcctaaaattggcaaccttcctcaaattcttattctaatattcacttgcttctaatttttctaggtagaaaattatatacctttctttctaatatttatacttcttgtcttatttttctatttatttggctctaatttctagaccaatgttagataccagtgtggatatcatggtattttctttaaaaaaaaaaaaaaagaaaaagaaaaagaaagaacgaaagaaacaaaattaatctggcattttcttctttttgtttttaatttttataaaattaaatttctatcttgtgatattttgctgttgtgacagctctgatgtgtgggaagcctttggttatctctccctttatgtgacagcgaagccttaggcccttaggctgatctgagctgggccaatcatgccttgggcctctgctggtggtgagcttgagaggcaagtcaggcacagatttccggagcattctgtgggcgcctcccccaagccagggccccactctagtgtcctcgtggtgtttagaaaagccctcccacacttggccgggcatggtggctcacgcctataatcccagcactttgggaggccgaggtgggcagatcacgaggtcaggggatcgagaccatcctggccaacatggtgaaaccccgtctcttcttaaaaaaaaaaaaaaaaattagccgggagtggtggtgagcacctgtagtcccagctactctagaggctgaggcagggggaatcacttgaacccaggaggtggaggttgcagtgagctgagattgggccattgcactccagtctggcgacagcacaagactccgtctaaaaaaagaaaaagaaaagaaagaaaagccccacacactcaacgctgagcgttgctggagggacgctctgctaaatgcccccagacctgaggctgacttttgggctgtgtgaagtgatatgatgctcttagaatgctctttacgtttttctggcctataatgtcagttggaaaaagtggcattgtaaagtcataaatctttttggtttgggtgtttttgaagctgggggttgggggagaggatggggaaagtgaggggtgtgattgcctctggtggcccccacgctctacttgttctcctgggagagggcggtttggaagaggcatgggaggagcttcccagcacagagcccagcctgccctccttctgtgtgatcccacatgggctgtccagctctgttagatcaatgctgcctcaactcggatggacaccaaaccctacggccccctccgctcccggtgaagcagtttctctgatgatttcttagaccccaccagcctaaaacatctctccctctgaccccaaaagaggcctgtaagtcccgaattgctgctttgtgttacagcatcagaggctccttggaaaggcgggtggtgcactcagctctgaggggcttctccatgaggccatctcttggccatctcctccttagcctgttcaagtcacacatgggccagctggtctagcagagaacaaataacgggggcagtttaggctgacaggccttggggcgttccatgatgcacctgactgccgaaggagggatggttccggagaagggaacagaggttcgccaaaggccccttggagtggcacccgtcttgcccaggccattgctgtggtggtctctgtctctgtctctgtctctgtctctgtctctgtctctctctctctttttcttttttttttttaatatggagtctcactctgtcaccctggctggagtgcagaggtacgatctcggctcactgcaacctctgcctcccgggttcaagcgattctcctgcctcagactcccaagtagctgggactacaggtgcctgccaccatgcccggcttatttttgtctttttagtagagactgagtttcaccatattggtcaggctggtctcaaactcctgatctcaggtgatcacccgcctcgacctcccaaagtgctgtgattacaggcatgagccaccgcgcccggccatctgtctctcttgacacttgttacagctgttttctccttcccccagggctcctctctggtcacgtcccactgtgagtccccatctctcctccgtccttttcctctttctcacccgccctgccattcgtctctgtgtctcttggtacctgtgacagtgtcctatttccttcctcgatgactgctcatctcccagtctcaacccccccgaaagcccgcctttcctccttgctgcctgcctcttcctttctccttccatctgtttccactttgtgcatttatacttggtattgtttaatattccaaagaattgaagagggttactgaaagctttatgtgcccatgactctaaataaatgtagttggactgagttatttttttgttcttggatgaagccagaatcttaaagccttttctacttagctgaatttatttttattccaaatatttttatttcattaaataaataataggagttgcattttaaagccctaactctgtggtacattgccaggctttcccatatggggctctttgcagctataatcaatagtgtcagagagggtgctggctgggttcggtggctcacacctgtaatcccagcactttaggaggccaaggcgggcagattgcctgagctcaggagttcaaaaccagcctgggcaacatggcaagacaccatctctaccaaaaaatacaaaaattagctgggtgtggtggcacacgcctgtaatcccagctacttggaaggctgaggcaggagaatcgcttgaaccccggaggcggaggctgcagtgagcggagattgcgccactgcactccagcctgggtggcagagcgagactccgcccctccctccaaacaaaaagaaagaaagagagggtgctcctgggtgaagatgtcagatacctgaatggataatgcactcttcttgaactcattccttggaatctcttccgagcctccacagtactaaccagtgtcttgcttcctttttcattgtgtgtgtgtccgtatgcttgtgtccacggtggacccggaactgcaggacgagattctgacggtgctcaggagagtggatgagaactgggcggaaggcatgctgggagacaagatcgggatcttcccgctcctgtacgtggaggtaagaccgtgccgccctcccacacttggctccttcttgcccacccttgtttcactacagtggggtcacctgaccttcaagccccttttctaagagagaaagaggatcctccacaatagcctctggccagagagctgctatgtgtgggctttgattcacctcatggggtcagtgctgtgagcactgccttggccagttttgagtggctggtcccaggcctggctgcaagtcatctcaccacgtgggcagtggcagcagggcccccttgtgcaccttccccgttttctcaagggacccctgcgcctggcacccatgcttctccaactcccccaagtgctgctgctcttttctcatgagcaccagaggggaagaacccgtcccaaggcagcattttcccttcccactgcacacggattggaaggaaccgttgctggccatctgcaaagtcctccttggactcagggttattgggcaactcttctgcctgagaggcaccacagcaaaggtgttttgaggctaattccagacctactaatttcctttcccttttctgtaactaaagcaccaggtttctagtgagtacgtttagggtagctgctgtgcagaaagcatcttaacacgtgtgtctttaaaacacctgctagcctggggctgtgtgtgtatgtaggagtatttgcctatggcgtgtgtgtctgccatttgtcagtgcaaggccacatgtgcacattggtgagctgaccacatgctttcatgctgtaaccaccagcgtcatcccataagagtggcttcagtgaatgcttactgagtgcttgttgtgtgccagacacttggaagtacctgctcatttaatcttctcagcaacactggcatatgaaaaccatgaatggccctgctttacagatgagcaaacagaggtgcagaaaggtaacgtagcattctcaaggtcccacagccgaggagtggcagaaccaaggtttcagcgcgggcctcttggccctagactcagccagcccttcactctcctgctctcacaccatatcctgcctctccactgtctctggctaatgaactgcagtttactcagctcagtgctgggctccatgtgtcccccctgcctgacacacttaagggcttcagagttggcaccgaaagcccacgggtgacacggccagctttgccacacctaccacacagtgtgcagatacttaaagatgtttgtttaaaacatctgtcaattccccgttgcctgcaggataaagtccaaatgctttagcttagcattcaaagccctttgcagttagtccatagtctattttgcagcctcatctctcatttcctcccctcttcctcaaatattcgggaccagtggttctcgcacatttagtttgaatgtgctgcccaggccatctgaggccctcccacagcaatggcagataattcacacacacacactctcctgtaagattcacatctgccctcaacacttcgcaagtttccatgtatttgcacatttgctttagcttttctgtcctggtgcttaagaccaaagaacttaatgcgcgaataccacttacaatgtcgtccagaagtcagaaatctgagctctcggacatttttagctggccaaacttttttctccaggcagaatcttactgggatacccaacatatacatgaatgttcatggaaagttcattacaatggccctaaacagcataccactcaagtgtccatcaacagtgggatggctgaggaaaatgcagtatatccatacaatggaacgctctcccaccatgcatgtgaacaaaagagtaatggctttaagggcataggcaaatctccaagtgaaatttttgaaagaagccagacataaaagtaaatgccgtatgggtttttttaggaggttcaaaagcagacagaactcctctgttgtgacagaagtcagagcagtagtgaccttggggattctgactggaagaggtaaggaggttctgggctgcagaaaggtttcgtgtcctgatctcgggagagctgcacagattatgctgctgtaaaatggtgtccagttaagctttacacacttctaactgcaatttcaaaagctaagagcaaatcttaaaggacaggtaagatcttaccaaggcagctgacagtagcggaggtggctgaaggctgcgttgggcccctcagcccctcctctggaagaagctgtcaggcaccattgggagtccgcaagcaggtgcaggcccgagacccagtccagcaggctctctgtcatctcttcctggttccacaggcacactcagagacaaactggggagtcagccgcatctgtgccttcctgcagcatgactgcctgtgggtctgaaaagccaccttaaagccctcctccctcagggccatgaggagggctccatagccccacctgcccccacaccccctcacaggttctgcctccactcttgggcacagtcccttccacccacctggataggaagccctggactgtccttcaggctcagagacacagacctcctcccaagcatccttgggcagggggccccactgcccctcttgcccctttctgagatggctgcccatgcagtactgggctccacgccacacacccatagcctggcagcctcagctctgatacaggctcccggactctcagcagccactgaagaccagcctgaacaggtgtttcctgggacttttcattctttatgtactgactgcttgcacgccacacaccacatggatcctggtggatcggaaagtcctggtttggcccaaactgcttccctctgggaggccgcacaggcatttgaggtgggaacttgggtgtttgcagggttcctgagagagtcagacccacctgccaggagggagcctggagcttccatcttgggctactgcacaggcagccggcacagtcccggtgatgcttgtcccctggtgcaagaaggaatgtagcagacccgtcacctcacactaagaggatatcttctttcatgctcacgtaagcttggattgcatgaaggtctcctccacagccgctccagccgggatctgcaggcacctggcagggttctacccagcgcacagctgccctatggggttcaccgagggactctcacctcgcctggcctcacctggcctcagcttcccatcagcgcagctcaggccatgatgctaagcccacggtggacctcacaaagtaaacgagagtgtgccctgcacagtgctctccctccgtggttgtgtctccaccagggcctgccagtggcacagtgagctgaagggcacacacctggcctggagccagcctggccttgcactgcttcagctgctttcagaggaggtggaccccgccctggacatacgtacatttccctctgctgttctatagaaataatcgtctctccacagcccctggcacccacctgccacaggcattcacccatgagctgggcttgctgcccctgggcactgaccccatctgtgctgtgctcaccggagatacctcactccctgcccagctcttcttcccatggctccagccaccgtcccatgccctggaacctgcctccttgtccttttcgcccatcgttttgcaaaaggaagtgagaaactctcctgcggccgtccccacgccaggacccagggcacgtctccctgacacctgttcatcagatgccagctggacagcgccccttgccaggagcctaggctgaccctgccccagtgtccactcgggcacagagaggagtgggcctggcctctcaccctctggaactctagtctagcggatgggacaagaactaaatccaaacactccaccgggccttccttctgggtctttagcccttgaggtttttcagaatttcagaaggcgcttgttctaaggggagtgaggatgagccagtctgaggaattcctcctccccagtgggccagggcagagtgaactcacaggaggatggcaggcgagggactccgtcatccagagttctgccctctctgtggcatgagtgccggggctgagcacccctgcagcccccctctctttctgcacagggtccaagttgacctgcttggggtcaggcctcggcccagccctcagctgttgagaacagggcccattcctcataggccctgatggcaggaccatgagcagcccatgggcagttcagggcgatgcgggcttcagagcagacctggctgggcccagcttgtcctacatcacctgcacattgggggcatggcctgtggtcaccccctttaccttcctgagcctcagtttcccccttcaaacaagggcagtggcagacgtcatgggctagccatggggcatagagaagataagaacacacaggctgggctggctggggtaggcagagagcactgtcctgtgctggtggtggtggtgtaaatgtttgtggagtgaaagctgctcctcggtccattgctgtgttgattgaagatcactgtgtcattcctgagcactgaacacatttggcctggttagctgaatgggtttgaaggcagggcagtttcctgcctgggtgaggtttgcagttggatgatgtcaacaataccaggacacaggtccagggtgtggacgcttaggagaggcagccctcttggaagctgtctttaaggagcattgtcaggaaaggaatcagctcgggttggagagacttgggggcgggacacaggctgcctctggctgctcacacagagcctgggtgggtggcttgcatggagacttagaaggcatgttagcaaatacgccagtgattctcgtctgcgaggaaaacctctccatggggccaggatcgtgatccaaaaatagttcaaaaaaatgatgaaagacagtagacacaagtgtcaagctctgcctccacattgacaacatcggttgtccaggtagagtaatggggagacccagatctcaaggaaccaactgaaaaagaccccccagagatagtgctttacttatcctcaataggatattcagaaattggctgctccctgtgttgctggtgtgtgcgtgagtggtcacctaggtagaccctcatgccctcaccccacacgtgcatgtggtggcatcccaaggatccttagagacagccagcatctcagcatctctgacagtaaagggcggggaggaagaaccccttcctttgttcccctaagtttccatggtgaacagtgaccatcctgtgcctagatagaccctagtctgcaatgtgaggacagacagagatggggtgcggagcacctgtcccggcagccagcacataccccagacaggtctgcttaggaaggaacagagagccgctcagagtccgggctattttgctgcctttggatttggcttgggctgaaaaaataggtgcctttccctggggggaggtctagaattcaatcagagctgtaactgtttattcttggcgtttcccattgattgtctgtttctaattgagcagcttttcaggggcatgtgatgggtgcacactcctctccacttggctaataagaagtgtgaagcctgagggtgctggacctccgtgggccagcggggcgttggtctgtgtggggagatgctggagcacgtggtgagcaatgggtcacagatgagaggtggaggtggggcccagctgctgatgatgagcctcctagtcatcccagtgtctgctaacccagaaaaaggccatagcgtcagtggctgtggtaggataaccctaggatccggggaagaagcagagctggagggggcagaagattcagactctgtgacgccagacccaagcctctgtctgctgtcaggatgcttgtgccttagttggttgttgaattaatatggtgtggtgtttgggaaaattgtggatggaatgctgtttatagatcctggaaaaaataatggcagccaacatgaaaatctttatttagtgaaataatataatacccagaaaaatagcaggagttcctgctgatggccatttcccgtttgagagtgcttatcttcagcacaatgatgatagcgtgcctcatcagaccactgggttctaagccttggttgatgcagcaacatcaagctcagttcctcctgctcctgtagcaccggtgcctccttgtcactttatcttttacaaagagaggctattattttgaacctctgcctcttaagtatgctcttgagacgtttggtggtgacttaaaggcacaacgacagctctcattgggagcggatagctcgggcattgttgttaattgtgcacactccgcgttctgcactacctcaaagtagtgagcagctccgccgtgttggatttgccattttaccttggtcttgtgggttttcggcccttgcctgggccaggcgggatgtgttcagggaggaagaggggaagggtgtgacttcccatgagagccacaagggaagtatcccaggtgctgaactgaggctcctctctcctccgcagcacctccagacctgtctgatcctgtggtccgggtgggttcacccaccggcttgcactctgggtcagggagctggctcatattcacagtcctggtctctgccttccctcctccttccaaagaccccctcagcttctctaagagaaacccagcatgccaagaaccacataggcagtgggagagggatggaaggatgggggctctagttctcaactcccagttgactttatgcacccccacctgagacggggttggaacacctccgactcttaatcttgcctatgaactagaggctgcatgggcttatggagctgtgtgatgcttctgaggcaccctcctttttctttgcatgcctggtaattttcagctggttactgactttgtgaattttactgtttgaggtattggacatcttggcattcctgcagatgttcttgagctttgatttttgttaaattgcttagactcagtttggtgtttttgaggctcgctttgaggctttgttaggcagggccagggaagcctttcatgtggggctaatttctctactgctgaggctataaccttctctactccatgccccatgacttatgaggcttccactctggaagttggaaatgaaaactattcctggctttatgtgacctcagagattgctctgccttctccttgtgggcagttctttccccagtgctggatagttccctcatatgaatgccctgatcagctctcagctgaagactccaggggactttctgcagatctccaggactgtctctctctacagctccctcctctccagaactctggcctgcatcctgtagccactgtggctccccagatccagaactctgtcttctcaatgcagggagaggctagagaacccagagacagtaacagagcccatgttatgggctccgccgctcttggtgattgctgtcctgtgcgttctgctgtcccatatctgcaaatcttgtttcacagatttgttttcagtgtctggagcaggagggtaaaaatgttacccatcatttcaccttggctaagcagatgttagccagtgatgctttaggaattttgaaataagggtcagaggttccccagggctcaatctctccagcttcagtgccaaagtaataatccaggacttttccttagatgaggaactggaaaacgcctttaaagtcatggtttaccatggagatgggttacaaccaaacgccaaagcccgtcccgtggtcccactctccaggcgagcccctcgcatgtttgtttcactgctggtgttccctacacttctgctgacagatgtggccgctgcttctaagagtcaggacaccctgatgatgccacatcagaagggatgtgaaagtatgaaggaaaaatactcagggatgtctgccagggaacgctggggaagatgcagttttgtttgaagtttcattttatttttcttgcttttcgtcatcctctgtttttacaagctcctgccgcagcgacagcctgtggaagggatcccccagccttagtgtggatgccaatcctgcttgcatttctgtgtcagtgtggactgtgcctccaggaacactttgtaaagccctcctgcaggtgaagcccggtcattgccaagaacactgggcaggaaagccagaagcgaggaccagaaggcagggaccaggaagcacccaatggcgtgtctcctggagtgtgatgttgtgtctatgtctgaacagagtggtccaggaggcaaattcttagacctatcagggagaataagcagtggtcttgccttcaccagtaacccactgtttcccttacctttcaattggattaacgacataaagaaataaatgagtgtaaagaaatgagacaagactacataagagggagactccagtcgcattcatggttggggtctgtacattttcttgccgggatctgactgccaaggcgtgatccacacatacatgggtgttcattgtagtttgggtttgtttgtctccagcaaaaataggtaggtgcctaggtaccggctcgccctgatttctctcttcttaagtctttttgaggtcttcgtgaaattaacatcttataatagaatatcttacattccattgctgctgggagtcttgttgctgtgattgttttgtctccctaagcccctttgaggccagacctgtaactcacagttgcttcccttctgggtcctggcacagggtggggcccaggtgctagctaccctgtgcacctgtgcaatgttattgggttgtggttcagtgttttacagagctcatcaagcatggggaatgccccactgaccatctctaaatgggtctaagctgggaagcttgcagcagttcttgtatatctgtggcaagacagcttagtaagtttttgtgaagccccttgtcctcgctgccagcctccctgggagcttctgtggggacagtgagtagccctgaccgcagcctgagtggctcagtcatcactggggccacagcccaccttaaatgttgtcagggcctggcgaaggggcacatggagccttgtgccatagttcctgaggtttgatctcaccctgcccaccttagccaggcaatccctgcccaccaggtgccccccaccacctgcataggcagacatcaaactttttagattcctcccaagacctcgatgctggagagccagacactaattcagggcctttggaggccccagcagggcacgcactggtcctcagcaccagtgcactcagccttgccagaaagaagctgcatgcatgtagaccagcaggagtcgttgctgattgccgactgttttggtaactaaaatggactacctgtgttggctttaagcagtagttgtgaaattgtgtgtcaggaagagggcttcctccacgggtctaccaagtggtctaccacttgctgagtgcagagccttgtcctggtctggatgcgacgatggaaggcttaagtgagtcatctcctgaagagactactcaggactggaagtgtgtcagcctaggggcagctgaacacccaggtggccctggagcaggctgctggagcgtctggcctgcagccggtggaagtaactgagctccaatcttgtgtccagactgcttctcccctaggctccagctgtttttctgcttctcctgtcactcatatggacagtgcactttccactgagcaggtcaatggcggggttacttttacacctaactttagctcctctctgggccctgctggtctcagcacgcacacccacccaatcctacggagacagagttctcacacctaccctccgcagggcatcttgggccatccacgtccacctgccctcccttcagcgtggccatcacggtgccctgactcagcttccagtcccccgggcttccatgttcttgtcttccctttcacttctacctttcctgcttgagtaagttaggctgtggctcgcaaacttcagtgagcatttgagtgttgtcagaaggcccccaggatggctaaatagtagaaaggacagctttactggtgacatcagtttgcaagccaggaatagatagtctctgacatggaacgaaggtgctctcgcttcgcagaaggggaagggcagttggattttatggctcgcagggtctgtgttacatagtagaatcagacatgtttagcaggtttgggggaaagctgtgcatgtttataaggggagctgagtgcatgtgcaatgggcaaacatgtacgtaacacacatctcatgtcactttagggtggggtttcagcattaaaatgaggtggaatttggctctttccatcaacaggtgaactataggacacaaagacagcctgtgcacagcctccataagttgctgaaactggcttgaggtctgcagttgcttatgagaaaggggtgtttgtaagggctgtcctctgtcccatcagagttgcagtggtctgggttataaatcagaggggtctgatagcacctattgttagggagtttagcaagagtgtggctttctttgtagcccaggaatttaggaagttaccatgccagcacataggtaactttgtttccttaaccatagggtctgtcttagttgctgaagggacatctgttttggtctcagataacacaagtcattgggaaagctgcaggcccagcccaggggagagtctgctgcagtggggctgactcagcctggggctgaggctgcctgcaccaggcccacctgcgcccagcccactggccacccacctccctcagcagcccacctcctgacccccgacgtggttggcctttcctcagtcctcatctgcatgaactctccacacttagcacatgcccttccgtcttgcagctgtgtccccaggcctcagcaatcttaaaacagcccctctgtcaccccacacagagcaccccagtcgtctccaggaccttcctttggaacaccgagccctgtcacatcttcaaatccttctggtgcattctaacatccgtctgccactgaatcttcagaacagccttaggggaagaggaaggctccattctcctggcgagagatgcagccaagccccatccagggcccgcagctgatgagcagttccatgccagaatttgaagttagcacccccaatgttctctgctttcaggattcctagtgcagagacatttggctgttggattatgaaccctgccccaatctgacctgcagcttctcctcccaccatctcattctatggattaatgtgtggaccacgctcttccaggcccatgctcacttctttcctgagtgttccaatcacaacactcaggacttgagagtgtgtctgaacctggagatcggccttaggaagtaccatccacatttaaagaagtttggaggaaaccggtgtcagattccatgcagccctgagggcgggccctggctccgaggcacttgtccccaggcagaccttgtgagtgcttgcagcttttcaggcatggaagtgaaagcatacttagctgtggagagatttggcactgggtgcctgtaggatgacagcagcacttcttggctgaggtccagggctatgtttggtacagaagaaaccatgtctgatttttcagctggaaccaagcacacccatgtggagtcactggggggtcatgggggaccccaaacatctttattccagagcagcccatctttgcagggagatctatcctacaggtctcggttgctgttgctgcctcacccttagttctaagacttggcaatggattatgaccaaggttgacactctgggccagttggaatcattcttctcttgtcttcatgcttctcctccatggtaccttctgttaatactttctgtttccaatggatagggtgcaggcttctgcgggctgaggcacgtttaagattcgggtccgggaaatgcccaaaccgtgtgtgtgccctgtggggtactttctgtaaccacctgaattccacctgtgatgcagaatgagaaacagcactgattccagcttcatttcgttgctgctcaacccccgcagaggagctcagagctactctctgttgcttttataaacgcctcccaaatccttgaaagtgagagcaattaagagtcttagtttgaagctcttgggacatcagccgcattttccagacgtcctgttttcagtgatcagtccgtccttataccctttaagtaatttctcatccctcagccccttccaccctaccaccccgctgagtctccagtgtctgttaggtagaaggttctgatgacagtctagaggcttcctggctgccacaaacagttccttcagggctggcccctcacaaatgaaggcagcccatcctttccatctctgcttccatcagaggaccacttgctcctcccacccttaggtttctgttggtggcttagcctttggtggagagagcacatcccactgctgggcagggcagtgccctccccacagttccttccaggccgcctggggtcccacgttcatccagtccttaagcgccggctgcgggccaggccccggggatgcagcctgaatgaagcagaggagaaccctggagaccacatctgccagggaggacacaacagcgaagaaaagcaagtctggaggggattctactctccgtggagaaagtaacaccaggagaggaggaaggacctgggaggagggaactgcagttttcctgtcagcgctcgggacttggcagggaaagcggccttcggggaggggcagggagggagcaggtccaggggtggcctgagctggccgagggactctaagccagggtgaccaagcaggcaggtgggaggagaggggttggggtcagaggggcagtgggaaaagggcttcaggggttcccgcaggtcactctgaggacattggcatctgctctgcatttgggtctggggtctctcttccaggccccttctctgccgagtgcccgcgaccttgtgcctgtgtccatagactcctcctgaccacgtccttgtcattcctaagcccacccccgctttgctgaggtgaactttgatagtgtaaaatgcatgtggagggagccttctagactaaaagtttcgagctctggtcatagggaacccacagggtcttgggcccctggggatgtgggcagaaggcctcagggtaactccaacccgatggttcccatgtggcttctgagggtcccacttcccccacagttcattctcacacagccatggaaccaggaaccatttacttcactattgcttaaagccaccagtggggcccattgctcttagaataaatctagactcctcactgcagtctaccctgtgggtccacccagcctcacaccctccctgcatgcctggccctgatcgttgtcccggcatgctggccttcctctgtcccttcatctgtcccttcctctgtccctctgacaggccagacccctgcccacgttggcatcagacagtcgagcagaagctctggctctctctgtcactccctgtgcctcagtttcctcatctgtgtaatgggagtaataaccttacccacctccaagggttcttaggaggattaaattggagacatagtgaagtgcacaaaacagcgcacaaagggagaagtatgtgttagaaatgattgttaacttaattgtagtttgggggccctgcacaaccccagtgtcccctgagtcacctcccatgtcactctgcagagagcaggaagaagcccccatgtcctgttgcaaaaatgcattttagtagcagcgtgttgtttttgatgctgcaatatgaatatccagtcctcttgaaaatacaatttggaatagtcttaggtttcattcgatgtgaaggaaacaatcacttagagaatgagtttccttgaactgtccagggcaaaggagcctgtttgaaataatcagcgcttttgggaaagggacaaccagtgtattgcaggcagagcctgaggtcagctgcttgagcatcagaggcagggagcaccccacacaagctctcagacctcaaggggttggccaagcctaagcctttgtgtcccagccagccctgccagggtggactgtgttatggctgcagacttatcctgcagccactggactgaggtaggacctggcaccagaaacaaaaaaaataaacccaggaggtcaaatttacacgtccataaagccttttgtatttaaaaagagatggacgtttggttgaaactctgctcttcttcatatttcttattggtaaatttgcaacacagtgcatctgttcacctgtttttaaatatgtccctttgggttaagttggggttttagttgtagcaattcttcataccctgttcttggatccagctgagggatgagctggaatggaagtgctagctttaggattgaaaaatctcaaaagaatgtagattggatctggaagctaaggaacgtgcatagaccttgaaagagagggtcaaggctgcaaagctgaccgccttgcctggaattgctcctttcaacagagctggggagggaaggaggaagtgacccaggcttccggccttctccccagtccctgaggatggcctagcccctgtggatctccctatccgttagagacgcatatggagcatgtacaggtgacattgtgtggcttctgcaatttgctggaagcagcagggaaggtcaggccgtacatgaagccaaaaggaccaaacaccagggggccgctatgactgttacaagaagtttaaaaaaaaaaaaaaaaacactgtggctgcttgtgtggcaagtgcagttataaacaatagctcagcaggcgggctgtccctcaaacaactttatttacaaaaaccagcgttagctggatcttgggccttggtttgcggcccttgagtgtgagtcctctacccacctctctgtgtttctgcttcccttctgtttgggcccggctaatccctaccactttctgagctcttagagcttatcctaggggcagccccaggatcctggcatctccctcaggtgtcagtccaggtctgtgtccccctcagctggtggctgtcacctagggctggaaacaaaactgcccaaggaagaggaaacctttgctagaccttgcctgaaacatcatgctcttaaaaaatgactgcattctcacaaaaccaaagacaccaaaggctctttagggcacctcacgctttgtacaaaatcaaaaaaaatctgtcactgccgcagctcaggaggtctccccataggtcgatggagactccagcctaatctgcttttttgtttctaatgactttttctgattataaaaataatacctggctattgctcaaaataagaaaattcagaaaagtgtaaagaagaaaattaaaatcacccataatcctaccagtaaatatgaatatatgtgtagagaaagaacgaggtgaaacgttgttagcatattgttctgtttcttttattcttttctatgtataaatttacatatattttggacaaatttgagattgcgctgtatcagtatttctgcctggcttttctcattaaattgtgagaatattctcataacatgattgcagtagcttccaagtgcctcacctgtgcaaccttttctcagcgccagggccgggggatcctgttgtgtccctgtgctgctgtagagccctccggttccccatctcaggggagatccaggacctcccaggggcccagaagcttcagcactagttgaccccatcacccccaccttatttctgcccatgtgtctgctccagccactctggccttcttgcttttcctcagacactccagccagctgctgccacagggcctttgcacatgctgttcccacctgcccatcacccttccccagatgtgatggggccagctccctcccacatctcctcaaggtcttggctcacaggtcagtttccctgtgaagcccatctgggccccctatttaacctgcagcccctcagcatatcctcctctcatactttttcctccatgtacttctcaccattcaacgtcctctatgtaatgaaatattcacttattccttgtctgggtatctgggagagcaggggttttgtctgtatttatttcacagtgctaagcagagcccctggcctgcagtaggtgcccaattccaccttcttcttccaaagcaacagccccagatggttggggggggggtctcctcccccggcccatccacccgcacacggcccttcctgactcgttccactgctcccacactggcccagattcccaaccatgctgaggctccccacaccaattccagggactcctcggtccctgttcaggagtcgacagaagctttgtgtccatcctgactcctgttcagccctcacagcctgaactcctttagacaactcttgacccctgtgcacacacatgcacacacattcaccatcctacgcctgcccacgcctctccatgaccttgaaatacttaggtcacttatgtccttttggttgaaatactttgtcactttctatggttatgtcctgtctgtaaccatagtaactgagttgtcttcccctctcagccaagcctttctctagtagcactttcattcaatttttcactgatgagttagttgcagcatgcctgttcttaagctcctttgtgaacatggaacacatcctaaagaaaagttcttgctgtgaaaaagctccacctgccacagattgcctggcagagctcacaaccagcagcaggtactcagtgagtgctgagtgaggcttggactcatgcaagatccaccaccctccccagccaggccccccaggtactctcagctgctgaccctgtgtctgaagtgtgatgtgagttacagctctgtagaggggtgagaagtgctgagcagtgtttagaatatactcaacaaacagccactgctgcatgcacatgcaaatgctagctgcattcattcaaacacctatgcatggaataggtgtttatcgagcatgtactttgcccccagcactaaacatttgaagcatctgtgaaatgagacccctgcaagaggatgaagtaggctctaatcctcagacctccaaggatcagctgtgacatcttgatctgatcactttggctttgttctcctagggttgctctgggatgtcagagagagactagagagaagggggtatagagacgggagggaaggaggaaatgcttgccacctggaggctttctaggtaatagagattagtggtgaggaggtagcaggtgagaacatgagggctgcagtgtgcagccaccacgatagtctggctgatgtcctgtaaaccacagcccaatgcaccatccctccagctacaccaggagcccatcacatgcagcatcataggcccaaggccacacaagccagggtaagttcaggtgccactcaccaaccttgggagctggttttctgtcccagagaagctgcacatagaacacaggtgagcgtacctgcagacacacagacatccagtcccagccccaggtgcctgtgggttttgagtcagctgtgagggcccctcctggtcctcagcaagaggggcaagcgtgggccaggccccgctccttgtgcatcaggttcacaccctgtgcaaacaggaggaagagggccttttatttctactggaggcaatgtctgtcatctcccctgggtgccgacagctttctgtctttgtgggtgtgacccacagtgacactgcatttgacatcttgaccgagggcataccgcatgagtgtgtgagcctagagaaatggtctgtgaagctacttccataccacatggacgcatgccaatatttattctattccgtttcttaaaaaggccggtcaggacccaatcaatggatcgtttgaaaaccactgctctaagccagagatctccaaggtagggtgcatgccactctgtgcaaagaagacatgagaaattctactcaaacttactgaaattttaacttgttagttttaatttctattttgtgtatggctattttatatatttttggtaatcaaatatattatttggtccactagataaatacaccaaaagatacacattacatatgtataatgcgagtgatcattggtacatcagaatataaatgcagaaatgcttccctgatgggggtgcactgtcagagaacaggtcagagcccacctgcctgggctgtggctgggccggccctgggagctctttgggtggagcggccatctgccttctcctgaatctgtgccagccactcctcttgctccccttgttcctcctcacccacctaagatctgcgatttctaaggcagaagcgccctgggaaattaatcactttggtcctcaggttaaaaatggccagaaatccacgtgcagcacacaccccaccggagggactcgcccaggatttaagtgtctaccggaggccatgcgggtccccacctgctgccaagggtctgaggtctcttcactgtcccaacagagagacttcccttgtggcagttcttggagaaagtggagaataagtgatgcccttcacacacttctttgcccataaactaccagtttatctccttttaggttcatcttcaggtaaaattatcacagggtccttatcccagtctgaaaacttctaatcagcggtccttctgctcacaggacacccctgctgaggggctaatcaggccgttctgctgctcctggtacttttatggacttggacacattcctagcaaatgagtgaaattttctgttttcttatttagtcctggaatcttccttctggcaggtcttaatactgaaatgacaatgtagattgccagtccaggagggacacatcacccaatatcaagaggttaaactcgaagcaggtggagcctcatttccccgtgaggactagggtgggatccagggaggaagaagggtgacataactatgacaaaggtgcaagtgggggtgcggtcggcatttctggttctgctggcgagacccatggactctgggatgaggaaggaggcattgacagccgcagggcagctggaggttctttggcagatcttggttttgagggctggcttgtggggcctcacaggggcggtcgcttcccgggctacccactatgagatgagcctggcccagggtgtgcagattcatgtgccacatcatagggcactggcagagggcggcccctgaattctctagagggtcccggcatgaatgctgctgtgggctgtgtgacagctggggtaggcgggcaggttccacaaactgatctgcagcttggccaactgcccccaagcagctagcacccagaggcggacaaggtggacgggtgccacctgcctctcatgggaccagcctgcacctgacagggacagggttttgtccagtccataagagggggctgaaatgaaaaccattcgctccgactccctcctcagatttttaaatgtcaactcttccaaaagccttgcctgtactcaggctttacgtgcaaaattaggcagccatttgtgcagtgcaggtctgcacctgcgttttaaacttcagttatccgaatagtcacctcagcttgccagcccattgggcagcccgacagcagcctgacctgtatgcttcagccattacaggacggggaccagggctagaatgcaaacaccaagaggacaggatgggaaaggcacatctgccatgtgctggagggatgcaggtcacccacaggctcggggaggggtgcgggtcacccatgggctcgggccttcactctggcagggccggcggcctcacacaggtctccagcacactcctgcagtgctctagtgttgctcagcctctgtcaaactaacttcaaggggggaatctcctccagggtagaagcctctcccatagcaggtgtgtggccacggcttgtggccgggcagggagcatcagtccagagtgctggcaccagtgttttacagatgcctagggttcgatgtccccaggaaataagagtttggcattgtccacaggcctctgaggccactacttctgtgaataaagggaagggaacagaacggccaccaacccttggtaactatagctggcatctgtcccatatgagaatttgcctgacccacttttcatgtcattttcaacctcctaaaaatatggtcttcttttttttttaattaagacagggtcttactctgtcacccaggctgaagtgcagtggcgtgacctctcaggctcaagcgatcctcccacctcagcctcctgagtagccaggaccacaggtgcatgccaccacgcccagctaattttaattttttacagagactgggtctcactatattacccaggctgatctcgaactcctggactcaagcagtcagcctgcctcggcctcccaaagtgttgagtttacaaacatgagccactgtgcctagcccaaaaaggcctgatttttaaagacccacatttgaatctctaaaatgtacccaacccattccaatagtcaagggcataggtatacctcagtgaatatattcttttttttacatcaagatgtagcaagaggggaagggcctcctcgtactctgcagtgacgaggggatggcagcagattcaatgagacatctcagaaaaggggtgagcagtagcaatggtgctgcttgttcactgtgtaacttggaacaggtcacttaacctctctgagcctcagtttccttatctgtaaaatggccacattgctgtcacctcgtggtggatataagggtctgatgggcacatgtggggatgaaggtaaagtcggcttggccaggggtggtcaccaggccccttgcttcttctttttttttttggagacggagtctcgcactgttgcccaggctgagtgcagtggcgtgatcttggctcactgcaagctcaagctccgcctcgtgggttcacgccagccgttctcctgcctcagcctccggagtagctgggactacaggcgcctgccaccacgcccggctaattttttttttcagtagagatggggtttcaccgtgttagccaggatggtcttgatctcctgaccttgtgatccgcccacctcagcctcccaaagtgctgagattacaggcgtcagccaccacgcacggccccctggcttcttactagcttagtcactggcaaagagtccctggctttggaagcctttctccttaaaggctcttggaatgttccacacacaactcttcaggatgaggggtgcctatgaggagggcgaaggaaccagtgtcaaagggaatccttccctctccaccgcccctgcttagtctcctgaagaatgacgtgttttacaactggcaagtgttgatcgaagtccagcccagcccagccatcttgcctgcccgtctcagtgaggggaagctcctgagatgtctcccaacaaaagcttcaggcaggcaaaggccattcttcatctgctcctgagtttttgaagctttaaggccagcaaccagccttggtggcctctgccgcactcagccatgagagtgggagcttcagggtaaggcgaacgccccacaggagtctctggaacatgtgagtctggtccatggagggttctcagggagggtgctgccattgggaagccgagcttgcaaacagtgttctagaagcttgctacaacaatggcatctgcaaagaacagcatcgtcgtctcttgggagctggcagaaatgcagaaacttggcaacagcccacacctattgagccggagttggcctctgtgaaggatccccaggtcgttcagtgcacactgaaatagaaactctttcagagcaggtctttgagcagagcccaggacacagtaggtgctcagtccgttttgttttccgaatggtgcatccatgaaaagagtcatgtgttgccttcttgttaaactgtgagcacttgccctcctgcttgcacccttggcttcctggatttccaccaagatgtgggtttcaggacacattccctcccttgtatcgcgctcccaagccctgtcgctcagtgctgaggttgctcttcctccactctgggtcagtgcaggggcccagggggacacaactactttgcgctgtttttcttttgaagctgggcacctcccacaccactgctcttcttttcatgttacagctgctgtcctccctcatgactggcttgccaatcttactccttttttaagaaaaaaaaaacaaagtctcctcagtcagacccagggatttggggtgactatactctggcgctgtcgtggacccagcgctgaaattccagggctggccgcacctccccaccggagtcaggagacccatggctccaggagctgcggggagagagtcttctctattcaacccagccccaccctcggacgcagccacaaggctaaagagcactctaaaccaagagtccattctgtagaactgtttaaaggatggatggaagaaactcttcagtttttcttacctttctagacagttctgtggttggaaagtggttgtggaagaaaatcacatctaacctaagaaagctggggagacaaagtgttgggaggggctttgctgagccagcaggcagccactcgaggtcacagagaccatagggtggtaagcggggtcccctgtgggatggtgagccctggcccaacctttactgtcccatggacaagactgcaccatccccttgagctaatctcccaccccatccggtttcatgttcccaagagcatcggactagggggtggcccctgcagaggggccccagaacaggggcaggctctgggaagggcacacacctgcacaggtaccaggagcagtcctcatgatgaatggataaagttaccgagatgtttaaaatattgatgttatcattttgtttccattttgtatggaagttgaaaatgtgttctctttccattaaaaaacatgaaaagtttagttattgggtgcattggttatgtgtgtgcacatctatgtaggagggggacgtccacctgataaacaaggtgacgccacatgcagatagagccactggagtcctttcctttccagatggcaccttggtgggaagggctgcaccctcaggccgaatccacaccacatgggagggcagagccacctggcttccctgcagcatggaggcctgtgcgcgagacgagtctgcaccaacttgcagagtgaggagctgggaaagtgtggctgctcctaatgggtgcacgggagccgccgtcccgcacaggcactggcaggcgagggcatcctgtgaccgtgggcccacaaggatgtgtgtggccggtgagggtccttctgattgggatggcaccggtgccaaattcaggcccagctttatgacgtgactaattggagcttgttgtgaagacaatgaaaacttccccagatggagagttttgccccaggatcaagtcacagatctgtagcagtgcctgggactccgcaggcaggccagtgcgtgcgctactcgcatgcctgtgtgagtatggcaagcctggtccccagtggtgggtggaaaatgactcctcagtcccatgtgtgtagagatgcatctgcctgttgaggcccttcgggttagtccactctgggctttcagaacgaagactgacagggcaggaggaaaggggtccatggagaagccccttggctcagaagcagagatgagtcaacaggatacagcctaacccctcctcttcctgggagacccctcggcagcggttcgcctgcctggctgctgcagggatgctggggatgctgaagctttggatgaggcattgaggactttcttctttgaggcaggagctcttacttctcctgccgtctgttgaagctgcctatcttggtggaagctttttgccttcactttcagcaccggccttcggctggggttgctaaggcatgagggatgcatgctgtctccccaccctcactctctgtctccgccgtgaaggcacagtgcagtcacttgtgagcagcctctcggggacacgtgctggtggccgcccagtgctcagtgacctgtggcactgctgaggggccaggcactgtgcttctggctgctgtgtctcctgatgagaatagggagcctggaaatccatgctgacattcagatcagggccccatctcttctggacttgcatacaacaacctgttggtgcctggatttcctgattttgaaaacagttttcagtaccaactcaaaagggtcacaggaggactaagtgaaacactccaggcctgttcctttggggagaagggaatcatttgagcccagcctcagcattattgctgccatgattgctgtgtaatgatgtcccaagtgcaggcgcgtggcaggtgtgtttagaacgtgctccgatgccagtgagtgagacgaatggaggactgcgctcactgtgccctgctgctgtgtcttcctctataccctgtcaagtgggcagagaacactggggtccagaaagctggctcccaggtatttggagagccccacggagggctgtgggagggaacaggcactggtttgttctctgagtagcacttaggaggaagcaaatgaatacagccataaaatagagcaaaacagctgagcctggttggaggaaacatttcaaaggaaataaccctagatttagatcacacatgttggagcccggagtgaggtttttcataacctccctctgaaaggcagatattcgtagtggaaatgctgacagccatgtgcctgggccgggtctgaaggcagctggaacctgcagccaccctgctcctgtgatctgctcggcctgcacggagcagccctgtgatggggccaccctttatcatgccacttaaactcagcagggcttctgggttttttgtttttgtttttttaactcatcaaggtgctaccagctgcaaatgctagttctgaatctgggtgagacctggtgtttcccttcactgattgacagcattgaggggaatctcctagaccaggctgacgtcagacttgactcctggtaggtgtgggggacaggcccctcctggcacctgcgggcctcacatgcaagggcttagcctatatccttagcctatgccaagcttacacccatggctggccacagagcgggcgtgactctgccccaggtagcctgcacttccatagcggctcacatggtccttcacttgcctgctgtggttcccaccttcgtggatctcactgactcactgcctctctcctcttcctttctgaatcctgtacgtccttcctgaccactgctgagtcccgtttttcccatgaaggcttcagaatgccccccggtggcctacctgcagttttcggaaagccctttggccactggcctaggtgcctctgtggtgccctacagcacagagcccagttgtgctgctgcagagaccctgtaggccccaaacccaaaacagtaccctggcagacagaatgtgccaggcctgcacacaaccactccaccctgctcagtttccgcttggtgaggagaaaactcagagacagctcccgcttcctcctgccctgagctctgtgctcctccagggagatctgcccagagggcagctggcatttactcagtttttttctgctacttctggaaaggtgagggagaaagagtggaaactcacaggcatttacccagcctgatggcatttgcctaacccagcttgtagcaatcatcccatgatgattctagtatcatagtttcttcccagccacctctgtgtacacaataaagagttccctctgctttattctttcaaatcactgtgagctccccatataggtgtgcacttaggctgagccaagtacagcctaagaaggaaggggctccattgggcacccaagtgggaaacttcctccaggtataggatcaggggacactgtcactcacagatggtgaactgacctaactgaggccctgaggaccagcccagggagccttttctcacagctggtacctccccaggctgtgtaattcacggaccttcccccagtgggtgtgcctgggctgcccctcccagcccctccaggtgatgccgcagccctgagaggaaggatgtggcttagccggccaggagggtttattccccggttgctcatggacttgaaccttcatgccacctttcctgataaccaccacccaggatcagactttcgtcaaactcttcactgcgcacaacgcctgctatcttgtagaacaatgggagatgtgggaaggagtcgtgtcctgagacctcgccaaatcactcaagatgacagattattgacacctcctggggtatgctcaggccagcttctggggcttgacagcctgagtggaggcggttactgaaaagagcttctgtggtttatgctgaccagagcagactcccctgccacagccggtcaccagccattagaaagtgcattccagtcacatgctttgaaatctcctccggggacctgcagtgctcagggcaggctgggaacctgctgtcatggagcatgcagggccagcccacgtcttctgatatggggcttccttcccatcttgtccctagtccctcactgtctgcaaggcggcaccgtgcatcccagaaatggccagcagttgaaaagattggggcgacaaggtagtggcccttggaaaactcttctttctctatgagtcccctctctccatcatggctcctggggtttttgagctgctccaaaaaccttttcaataaaacctatgccaccccaccagcctcttctgtgttttccctgcagtctgacggatttgaatgcattgccagtttgtgaatggaaatgtggcctggagagtgcagagggctggtgtggcatgtgaccatgatttaatgcagcctcccctctcccctttctcactcagctcaatgactccgccaagcagctcattgagatggacaagccatgcccagccgctgcatccagctgcaatgcctccctgccctctgactccggcgctgtggccagcgtggccccaagtcccactttaagcagctcaggggcggtcagtgcctttcagcggcgtgtggatggcaagaagaacaccaagaaacgccactccttcaccgcgctcagtgtgacgcacagatcctcccaggctgccagccacaggcattccatggaaattagtgctccagtgttgatcagctccagcgatccccgagccgcggccaggattggagaccttgctcatctgtcgtgcgctgctcccacccaggtaacatcccgcgggccagggcaggcatccctgggttctctggggttctatcctcagctccgtgttcagtgtcccccgttcctcaactagcatggaggccgccccagaactgccttttggggttgagtggggtttgccctttgctgcctggcactggggcccccctagaagcgtggagaatggtgagtgtgccctccctggttcagaagatggcctcgtggtgtgtgagctgattttcagtggtccagggaatgtctgagtaacacccacccgcctcatgacaagcttttccccgtgtcagtcggcttccagatgtctgattatgtcctggaagagtcttggcttagtgctagcatatttttaccatctctgcaatgtttgctaatttccctttcaagagaaagaaggagtcagagctcagaatcagaatcaactacattgttgagtactttcgttactgttgtttctacagataccttctatttctagactccatttccactagttttttttttttgtaaattgaagtaaccaaagcaaagtatttaaaggctgggcacagtggctcatgcctgtaatcctggggctttgggaggccgaggcgggaggattgcttgaggccaagagttcaagatcagcttgggcaagaccctgtctctacaagcaaccaatcagtcaatcaataaaataaaataaaatgattaaaaaaatttttaaataatgaacaatatttagtaagtacttgcctgtagctctgacaagacccctcacagtggcatgcacagggcaggagttgggcaagtttcccctttatgaatgcagagactgcagcaggagatggaaggggctttcccagtgcccggcagggtgaccctgcagccacactcctgtgccattgttgtctgaccttctgcaggactgtggcagatgtccatgggtgagcccaaggtgcccacacaatggtgcccactccatttctccctgcgctgcagccttccacccagcggcccacccgccaccacgctccacattccttccagagtccctctggctgccctggacaggcctcagagcaagggcgctgatctgcggggaatcatggggcagacaccaataagcaactggctgggaagaactgtcttattcaaaatcacaatgaactcagacaactttacacacagaattgtcttaaaaattgctgagcttctggagaagggccatgtaatctagatgtgccacatcagcctagaaatgccccctacacacacttgcacacatgcacgcacacacacacatattacatggacacttgagcacatgcccgcccgcacatatgcactcccacgcacatgtgcactcatacacatggcacacacatatacctgcacacccacacatgtgcacttacatacaccgccatccacatgcacacctacacatatacacatgcacgcacatatacacatatacacctgtgcacatatgtgcacttatatgcaccccttccacatgcacacacatacacatgtgcacacacatgcgtacaggtgcatttacacatacacccctccaggtgcacacctgcagatacacatgcacacacacgtacgtatacacatacacacctgtgcgcacacacacacacacttgtgaacttatatgcgtcccttccacatacacacccacacatacacccgtgcacacatgtagacatttatacatgcgcacacacacattggtggatacacacctgcacgcatatgtgtgcacacacacaaacgctggctctcatcggcggctgaggctgaggtctggaatgggtgctgtagtgtctggagctgtaaccgtgcagtcatctgcccccatggttaccccactgcctggatgctcccacagcctgtgcctgggagccatattccccagagaacagccattggggctgctagtgcattttctgtaaggggaaaagcataaccttggtcccaaccctaactccactcctgacctgggctaaattcttcttgagcacctcctatttggaaattcctgggaggggcatggtgacccagtggcggaccagtgtggctgtgctccctgtgtgtgtgcacatctggggggtaaagccacaagcagtggctcttggaatagtcttgcttattcttgctcaaacatccttgacaccgggcaggttgtcatggtggtgctaagactggggggagctcaccctgtttgtcaccaatgacaaagtgtgataactttggcccagagctggggtccctccttggcaacctgagcaactgttggcgatgtgaacagtcgaaagttgtgttgtgaaacaaatttggctcaaagggaagttgcagcaggtttgaggggtacccctaagaagaggactgaggagcagcggcctggcccttgtggaccacttgggtaggtcgtttgtctccttcctcctagaagagcaaaggccactctcactgtagtcagggacccccatcaaccagagggagggcccttcttcctgatcaccagccagagatggccctggaactgccaggccagtgcctatcctgacaagtatctggcctgtgtcctgtaatttgtgagtaatatgtccaaagctgccctcggtgttccttggagttctaaaaaaggagcccacagggcccatgactttgcaaagctgctgctgtgtcccaagagggccaggggcatcttctctgccactttcccacaggcccctgagatgtgggctcagcacacacaggtacaggatccggtttcctctccttcctgcatcctcacctgcaccagcctctcatgttgccatggcctccgtgttaaaacaagcagagggaacctttctaagctctctgcagtctgatgtctattggggctggaagggaacagatgtttctattaatttgcatactacctggctccacagggattagaattagggattgacgggactgggatcctgggatccattttccagcagttcgacttgaagcgaaagtcatggccaggctactgactttagtttgggtcacctcaaagggcaagaggtcaaataaagcagttgccgcctgtctccctgtcctgatttaatcgagctgccgggagacagaaggggcacctggtgcaggtgtgagctgtgtatgctgcccctgcgggctccagtgtgctgctatggtctggatgtgcccagagaccaagccctcccggtctgcccctgctctgcactgccttcctggttcctaccaccttgctggccatgtgcgtctgaccaggaagtgcctggcctgaggactggcccatggcagccaaggcgagccagactcaggtcctgctgtgaccacagtgctgcagggattctcttccccaccatgctggccacagcccaggagagggagcccaggcccaggattctgtggtcagtgggtggcacttcggctttgatcatcggcttggagaaattcagcattgctgtgtcatgggctcatccacaaacagaggcccctcacatgccagcactgccatcgtgggaaacgtggagtggacagagcaggaaggcccgcagccccaggctcctcggtgcctacagcatggggcagtgctggccccagcaagggccactgcagcagccagtcccctgcctctcacagtcccctcgggacccagtgtgtccattcaggctgtgataaagaacatcttgactgacaggatgaattcttggcacctggagactggggctgtaggggaagacaggatggtgaagtgtacaaggctggtcatctggaccaggacttctgggccatggggggcagaggattacagatcgtgggttgtgtgtcccagtgcatttacttttggggtgagcatggtatcgtccctggtagttattgaatcctcattgaacgttgcactgggttctgtagaaaggtccaaacagcaggcgtctgccctggaaaagcagctggctggagtggagatgggctgcttgctgggcactgtgctgtccaacgcatcgactgcagttgatacacagtcagggtgggtggggggatgtggatgaggaagccccttagctggccgaattaaggggctctcgctgtaatggactggttttgctctttctttggtgttgtcttaaaatagaaaggaagcgtgcgtctgtggtttctatagaaatgcgtctgaggcacaggggacacttccctgcttctcagagtgcccgagcaccatgaagcctgggagcacagcctgagagccgcgcactgtccgaggctggcctcctccccgcagctgttaggggtgcgtctgtagtttgcctgtcccccatctctccttcggcttcttctgctgatctcacctcctctgtcctggcttgcatcacttctcagcttccccgactgtgtggcccacctcaccccacagtgagccaattgttcattgtttccacttcagagatgaggaagccgaggccccaggggtagtggtgacacctcagggctgtacttctgtgccagccctccctggccttccagggccccactcttgtcaggacatggttatcacttaactttccagtttactccataaaatgcacagggctgacctcaggccaaaggagacacgcaggagaatgccagcaggtccctgcggtgctccataaagtgcccctgctttgcttttcttttaggctgaggccaggctcaatgcagggtgctggggtggaggtgcaggctccctctctctagctgtgtcaccccaggagagttgctgaacctcttggagccctgcagttaagagccagcctccagagccagacggccaggttgagcacttatccttgcacctgcaaccttgggtaagctgcctgacctcttcccaaaaactcccctacctgtctgtggaatggagccaagctgtgcgcccccaccatggccactgtgagggtggagtgagggcgtgcgtgcgggctgccctccttggtaggtgtaccttgagtgttggctgtggtggctctttctgctgctcagggaatcagggaatgaatcaccagtccaagacaccaggcaccagacacatcatctctagtcactgctttctgctccaggagcccatctctggcttggtgctgtgctgggtcctggaggttttggaaagctggtggtgggtaagaagtgggtgtggccgagaccactgcaggatgggaaggaggggaagtaaaggaaggagaagaaaaagtgtcagagactgacacccacacagcctgaaatatccactgtcaagctctttgcaggaaagggctttaggctgaggctttgttgatgagaatgctgaaaaggaagagctgtgaaaccgaggagagagctgggagctgtgtaaggtgagctcgaggcctggcggggagtggggtgccgatgcagaacaggccagcgcctggcctctgagtagccatgtgggaaatgctacaagttcgagactgggagtctcagcagccactctgcaggggcagggacaggggacagaaagatgggggagtggggcctagacggaagttttgccgggcctaggctggccacaagcacagtcaaggtcgccaaggagctgctggggctggccactgggcacctcccagaggctgccacgggcacacagggcctgggcaggtggggtgtggcccaggctggcggccaagcagagctgacccctctcccaccgggtgccccctcccagcacctttgcggaaggcccattctcattcttctctcattgacctactgcttcctctttcccatggatgtgctcgactctctgcagtccgatcttgcccaccacccctgctgctgaagctgacccagccacagttaccaatgccctgtccagcatcctccttcctcatccgccatcttgacctcttggcagcacttgacgctgtggacagcaccccttcctgaacctgtcccctttgatctgtgcctcttctttccagtggagccccgtcctggcccctcctgccagaccctctttctaacccctatgtctacacaaataccccccaccttctcttcccctacatctctagcccctacatctacacaaataccccccaccttctcttcccatcctgggcatactcacccatgggggttcaccctctccagaaccccagccaacgtcacctgccagcacctcttttaaactacagattctcttctccaactacctgctggcttcctggagagacgcctcaacttcagcgcatgccaggagcaaccgatgacacccctctttccgcaaacctgcttccccttctgtattccatctgttcctcaaggagtcaccactgtccttaggtgccctgagctaacactcttcgtcttcgctaatacccttcgtcttccccaacactgactccctgcccctgagttccctcctgagtcccttggaaggttctggggagccttcagactggcccttggttgcctctccagctcccggcagcactgtccattcccgtgagcctgtgcagatcttctccctgcgcaccacgctgctctggccctggtccatttctccccgaaactgccgtagctaatcccttcccacctgcccatgtcccttttgctgcccctcagcatggcattctacctaccaggcaacacacagacacatacctgtgcagaaggctcctgcccgcccttccagaccatctgacatgttcacctctccgcagctttctatggccccatgtcacctttccaccaccaaatcaattcccccactgtctctttgcctacaggacttccagtgtgcccatgatggaatattatttgtgtgtatggccatccccccttcctccctgggcttttaggtccttgaaggcagggctaggtgccactggcccacaggtggggctctcacacgctagcttccttgttgggtgggccacaagacagcaccggcagcattcctcactggatggtcttgtacataaagcagcatggtacctgagagactgtgtggccttccccaactcccgcaggcccggctgcacatcgatggctggggagaggacacagctgcggggctctggctgaaggtgtccagggcgtgcagccggctgagcctcagatggcccgtcctgctcatgtttgcacccctagggattcttcctctgcgactgggagaggtcagaggctcagctggtgctctgggcataatggagtatcattcacatgtcagtgctctgctgggggagggaggttaatcagaggagagggaaagaggccattcaggccaactccactatgacacatttgcttttgaggttactggatcaaatcgggaaatgattgcttacattttagaaaaatttcctcataaaccaagtatgaagtcaagcaggtgcccgaggaccctaaatgggcagtcagctctggagtgcccaggtccatcactgagagcagctatatcacgtaataagcagcccacgttctcggaggcaccaagctgtgaatgcttgcttctcactcatactatgagtcaccggtagaagagggcttggctctaccatcctcacctgggacaccaacaaacaccaggctgagtctagccactacttgttttggtaaatgaaagctttgctggaacagggtcacacacgcccatttgtatatcatccgcagctgtttttaggccataacagagatattgaggcgttctgacagagattttaagacccacacagcctgaaatgtttattactgagcccattacagaaaatgccttctgactcctggtgtagaatgtctccaggaccatagcaggggcagaaatgaagcaaccagtgcagaggctacatggaagcctctgctcatgcgcatttcagtggtcgaagccaatcttacagccccgccctgttgaggggtgggcacatggagtccagcggggccttgaggagaaccgtccccaggtgccacttccctgcaactcagcaagtttgcatttctgagcacagaagttgggaagcttcaaaggaagagacgacacctttccaaagtaaggctagtgtggctctgacggctatgcttgcactgctgtgtgcaagcatatacccactaatactgcccatgagtgtcctgcctctgggcaggggctcttgctgggtccagagtgtggtcagatgcaggctgactcgccgtccagccaggaccagcaccttcattggcccttgccagcttctctgttctggagagcaccatggcttacaaattacctccaaataagcaacccttggaaattaggaacataccctttaaaatcaatggaaggggaagtgtttgaaattcagcagggagaacatcaaaagacagcatttctcaagtctcttcgtgtctgagaagtaaatgaggagagttccttatggaagcttctgggcaactttaaaatgcatcaccacctgctatttgtctctatgcagcttcctgtgttggctgggtcttattatctctgccacaggacagacagacagatgcttcaagcaggaggaagtgctggggaaaagctgaaggagctgaagcaggaccttcctgcctcaggcctggcagcccccagacttactgcttataagctgtgcaaactccggctccagctccagctctcaactgcagagtacaagctgcctgcatagcagagcacctgggcttatttttagcattttcagaaagttataaatttaattacatgccttatagggaggcaaaacaaagtaccaagtgagcctgggatgaataaaaaaaaaattgcattgtgagaatcttatacaagaaaactttcttctacaaatctggaaatagctgtacctccatgacttaccaatcctggcctttaagtggggacagaggacaccgtggctgcctgtgacctggcgtcctgatgatttttgtcgattgcaaagcttaccaatcacagtgcagggtgctggcagtgtttcttttgctgctatgacgagctaggaaccagatccacgggtttctgcctgtgcctccaggccatccttgggcagagtcaggaaagatccttgggtcttcttggcatttggagagcatccgggagctctgggtgggcacttgctggctagcagcacagaagagtcactcccttgtcctagcagctgttgaagccacatcctgcagggatccacagagggttgttcatgaatgcccaccggtaggccccatgggacccaccaggagactagcacacagtccatgcctcagagggtggaaaggaggaagggcctcgatcagtacaggtaaagcaggaggaaaccaggccactgaggtcggtgtcctcagggctgtaatgtgaagacccatgatggccctggacgggaggactgtgaggagctaagaaccttctccacccagatctcctgactgcctcaccctccctctgccagagctcatctgccctcccgctccaggctaaaccacctacctccccacaggcattatctggatgcagtgtgggtttgggaggcgagaaaaacggggtcccacacgcgctcacgcccaggccgggttcgctctcaggacctcgtcctcccattcgctgtcccctctaccagcccgtgagcttcgctgcggcaagagagtgctttccctctctgtacaggcaatgccccgcactggcactctcagacagaaggatggatagacggacacactgaattagagctgaacaaaaggatttttcaaagtccacccctcctgcagccaccgcctgtaaaggaggcactttctgtttgaagacagaatggatgcacagttggatgtggatgaatattgtgccttttatgcaaagctggatggagaagcctctggcctgatgggtgcgcacagggaggggggtccagggccttcctaccatcagaggcaacaggcgagtgagagctgtgaggaaggccatgagcggaggccatccacggctcttcctgatagaagaaaggctccagggcaagataggttgcttcttagctgaggcttgggaagccccgggtaggcgagaaaggggtcctataacttccttaacagacctcccctttccttgttgacgttttgagattttcattcaccaaactggagtcgggttgtggatgttctcctcccatattccactgttttgatccattcgccttagtaatattgtgggaattccttgttaagcttttgatcacaactttcactttttggttccagttattggcccagtaagacaaaggcagaaaggggaagaggttcatcttctcatcatagacacctagagcaggggcagcaaacgttctaaaggaagcagccagatagtaaataatctagactttgcagccaggtagtatctgccgcagtgactcagctccaccctgcagtatcagagcagctggagacagcagtggatggtgggcatggctggctgccaataaaactttattcacaaaagcagaacactgggccagatccaacctgtgggtgagaattaaatatccagcagcaaatttggaactcctacgggggcaggtggcttgtgggcagcagtggaggggagttttggcctccatcttcagtggtgagcaagcagttcccctcaccagctgagagtgctgaagttatgtgggcagaaggcgtggctgctgcctctcccaggacagactccctcactggggctccccggccactgccctccccgagagggagatcgagaggcacgcggggcctctggctacacaagctgcttgctcctctttgcagaatcaagcagaagaatcagccataaatgttttattctagagttttctttgggaagcaagttcatgagggtctgatttacaccccgtgtaatggagtggtagcgagtgatgaataatgcatgcccatttcactgctccttggggtgatgacagtgttttctggacttacattaaacatttaaatgaggagatgtttcttcttggggtcttcatctgttccatagtgtcaaagaaagagactcggagcccccgtacagcctgccaacgcccagaccctcttttttcccttttagtaatcccagcagggaactaatacggcctggttcccagccactgcttaggggccccattaaaatgcagcggaggaggctctagtgtctggttacaacctggcggtttagaatcggggaaccgcggccacagcactgcagccattgctgacaccaggcttccaaccaggggaggctggaatttgatgaaacacatcgccgtcacagatgacagcccaatctttactgactagcagctccagcgctgtgtgccattcacctgtgagctctgtgacagggagagagatgcaggagcaatggagcttgcctggatccagggcactgcacagtcagactgagctccagccctgacctcggtgcggagggcccctgcagctccgtgcacccagggggcagcatcagcgtgcacgctgtcactttactgtttgcttgtgctaagttccatcagacaggccatcctctcctacctgtagccctgccagccgaccttgcactactgggctcatgtgaaatgctcacaggctgtgttgttgagcatcctgcccgagggagggattgctggagttgttctgtagggtcagtgactcagagaactgggccactgcatgtcagccagctccttcggaacatgtgtgtccacttgcctaggccaaatcctggcaggtatccattatggagccttttaaaaagaccgtggtgcaaacgtactttattatagtcagagccctttcctgggcatgggctgctaggcgcgacttcgtgggagacagggctgcacttggctttgaagtcggagcagagatttccattggatgatcttggagataggatgaacatctgtctgagggctgtgtccccagttatttttactcaaaggcacctggagctctttctcttttcttgttttatcactggctgactccctcactcctgccaagtctttactaatcccttaaggcctagaatcatttaaaattaagccattaaaaatcaaagcagcatcagagaggtggctcgtggttaggaggaagccaggcctgcgtccagggccaagcaccatggttggagctggaggcaaggagccctcaagtccctggtgtcacagtcagcaactctcaacctcgttatgaatacttcaggggagaggcgccattggttgggggctgaaagtacatccaggcagtgcgcagctcaggctttgcaggatgctggccgtgtggaagtctgtgcctttactcaggagttcccaattacagtcatttaaaggagaggcccctttccctgcagttagttcctgccagggttagcagtggctgctcatctctgcccctcagcaggcctcgtgttcttgggagtcacattctgtacagctgggcctgtggcccccagtagcgtgctgctgagcctgtcagtgggaggacccctgaccccctcccaccttggccaccagcaaattgctgctcgtttgcatccgtagcaacagagaccagattcagaggatggactgaccccatcagcatcgggaagccacgaccagtgtgccactcatttctttgtacttttagttttcatatccctgagggcagagcccagcccagcgttgcctcctacacagcaggatgtccctcgcacccctcgccctgggtaccacaccacacacccatgctaggaaggccggccacacgggagccacgctcagccatgtcagttttaggcattcttcatcttgacctttgggaaaaagcatttccacacatctgacctctctctgctcttcattccagctctaagtaatagcttactgttaaatcccacatatttgcttggagcttttgccatatcaagtgtcagctgaaggccaggattccagtgaagccggcagaatgtctccctcctgctgtctttagggacagcctgtgtcagggtggccaaggccccagacccctgaatgggccctgtggcagctcccactgtccacacctcaggttccttggctgagccctcccgagcctcctgacaccgagccctgtgggttgctttacgttggactcacgcagggcagtcggtggatgccggcacagatgggatggtgagccttcggccgccgtggtccacgatgcgtgtgctccgcacagtgtgcactctcagcctagccttcagcctctgcccagcagacaaaacacagtctccttggtctctcctggccaaacacattgcccccctttcattggagtatggcttgagcagctccaggacattgggaggtggagatccaagtgccggggcaggcttcaggcaggccaccctcccagtgtggccccagcgtggctctggctgtgctttgcttgtgctatgctggtttgggacagcttggctgtttctggagcatttatctgaacaggacagcaggcatggtaacaacagcaggaccagtgcgtgcctatcatcttaggttcccactcttcccgctgctgcagagcagagtgccagtgcctgggagcacagaactgccagcccagcccctgctggtgctgcagggtcacccctgccctttgtcagctcccaggatcccctgacaaagatggcacatgggggatcgagaaagatacgggcttaccgtcagccagacctcaagtgttaactctgttattcttctcataccactgtggaaatgtttcaggaaaccattgtcacttgatattaaagtgtagattaaaaaataataaaattatcccaaaaggcaactccccaaaggagcaaagttatggtttggtatgtaagtttcctgacttcttgccatgaaaatacacgtatcactgtcagaaattagataagccttcatatgcaatgctgtcacctccatttccactctgcataccctacatggccctccaggcctgtccatggagaccacggcacaggcggcagtggggcattctgtgtccttgtcagcctgccagccccacaccctggaacttcaggagtgcaggtttttcgtatcataaacagtgctgctgcgaaatccttacctgtacctcctttctgacttgtctgattatcattattttatatatatattttttgagatagagtcttgctctgtcgcccaggctggagtgcagtggcgtgatctcagctcactgcaacctccgcctcatgggttcaaacgattctcctgcctgagcctcccaagtaactgggattacaggtgcttgccacaatgcccagctaatttttgtattttagtagagacagggtttcaccatgttggccaggctggtctcgaactcctgacctcaggtgatctgcttgccttggcctcccaaagttctgggattacaggcgtgagccaccaccccaggcctgtctggttattttaggattcattcttaacaggaaactgccggggctacaggctttttttcctgccctgtctctgtctgtctgtctctttctatctctgtctgtctacctctgtctctctctgtgtctctgtgtcttcctgtctgtctctcccgctctagaatggagaacagctttgtctacaagcccaaatcaccaggacctggggctgtatgagaacgtctctggcccccacattcccctccctattctgtgctctggggcagcacgcctgcccccaccagccctccacacagcatagacatgtcatgagggccatgccttgtaggacctgagtttgcagacttctctgttactaactatggcagaatgggacagaaaccaggggactgtgggtccactggcccaagccaggagtgagggctttccctgcagggagcacactggggtcttccgcatcccatgagtgggatcaagaggtgtaactccccaccagtggtccagcaggggcagtcacctgccccaggaagcgcctgtgcatgtcagcattcccaagaccagtgggtccttctaggtccttggcttccttggccattccacagcatgcagctcaatggacaatgacattccctctgaagcaccatctcccctgggctatgggtctccttctgtttattgggctgccccatcttggcctccttcagggccctcttctgggtggtgtcccgcagatggggccagggcatgctccctcctcactgtctcccaggccactgcaccgtctaccctgttggcttcaggacaacgatcacgagcctttgttgagggcctattctgtgtacttagagtgactgctttatagcctgtgggttgtctgacttcatactccagctgtctagaccatgcaagctgccacaaccccatcttctcatgtcttggggactctgtcctccactgcttgatttctatagtcttgggagctattgattcaggtttcatctggtttttcagttttttcaggcaggagggtaaacctggcccctgttaccatcatggtcagagcagaagttcatgaccctcaatggacacgaggagcaatcagaggctcacagacgccatcttggctacggtcacaaacacaggtcacacacctgggagctaagggctttgccacaagactgcattgcctcatagatcagctatacatacatgaccccagatctgctgcccaggccagtcccttctgagctcctgattggcattaccagcaccctcatcatccacactgagacatctccaggcacaccaaacactgcgtgtccagcactgagcccatggcctctgtggtctcttgttcctgtctctccagcagcatttccatctggccaaggctagaaactcggcccatgctcctccctcaacgtccttcagacctaatcttgttggtggagaagggactgatggcccccacacatgtccaagtgctgatcccagaacctgagaatgtgtcacctcatgtggcaaacgggaaaagaccctgagatggagatgctcctggatcacctgggccaccgcagccacaaaggccctcccgagagggaagcagaggccagagtcagggaaggggatggcgtggtggaagcagaggctagagagaggaagacgtggcactgcttgccttaaagtggaggggaccaaggaacgtgggcagcctctagaagctgcaaaggcagggaattggagtctcctccagactcccagagggaacacagccctgccacaccttgattttagaacttctgacttcaacaccttctgagtgattgtaagcccctgagtctgtggctgtttgtttcagcagctgtgaggaactaacaccacggtgtggtggctaagcacgtggcctgagttcaaaataataagcaggctgcctgagttcaaaatacccatctgcaggcttgcgaaggttgaaagcattgttccagggggagtgctcagagctgggcccagccatggtagactctgcacagggcgagtgctaccatcacgggtgctacagtcgcggctgctattcctactaacagccccctgagcgtgtccagaccccctcctgactcccttgccctctgccggtgcaggctgggctccctcgcacttcctgatgggttccctgcaaagctgcaggtcctggctgtggctgccttctccctgcctgtcctccagggacgccgtgccctcagactgaagaccagaacactctcaggaggccccacgcagcctgtcctcatcccgtggggatactgccccctttgcctccaaaccgtcacttcatctggcctcccaccttagccagcctgggctcctctaggcccaccacccaccctcaccacctccctgctgtggcttgaatgtcccctctgaaattcatgttgaaatttaatcccccaggcgcagcactgagaggtggggcctttaaaaggcaattaggtcacaagggcaaggctgaataatcactcatggattcctggattcatgggagcagggctggtggctttctaagaagcagcagcaggacctgagccagcatgctcagccccctcgtcatgtgatgctctgcagagtccccaccagcaagaaggctgtcaccagaagtggccatgcagcatcgcacttctcagtctccagaactataagaaataaattcctttttgttataaattacccagttttaggtattctgtcgtaagcaacactaaacagactaagacattccctaacaagactgcctcatgcctttcgaagccctcccagccacgcccagcccaggttgggtacctgtgtaaggggcctgtgcacgctgaacttcctagggctgctgcatgcttagaattacatgtccaggctgggtgcagtggctcatgcctgtaatcccagcactttgggaggctgaggagggcagatcacctgaggtcaggagttcaagactagcctggccaacatggcgaaacccccccgtttctactaaaaatacaaaatatctcggctcactgcaacttccgcctcctgggttcaagcaattttcctgcctcagcctccccagtagctgggattacaggcgtgcgccatcatgcctggctaatttttgtatttttagtagagacggggtttcaccatattgaccaggctggtctcaaactcctgaccacatgatctgcccgcctcagcctcccaaaatgctgggattacaggtgtgagccactgcactggatattgtgccactgtactccagcctgggtgacagagcaagactctgtctcaatacaacaacaacaacgaacaaaatattagccgggggtggtattgtgcaactgtaatcccggctactcaggaggctaagtcgggagaatcgcctgagcccagaagcagaggttgcagtgagctgagatcgcgccactgcattccagcctgggcgacagagtgagacttcatctcaaaaaaaaaaaaaaaaaaaagaattgtatgtccagtgcttggccacctggattgcaagccccacacagtcacaggccatggtgttccccatgggggcccagggccagttccgactgccaggtcatcgagtgtcagtgtgtcgagcctgttgtccctgtgttggaattgcttggtaactatttgaatgggtgagtgaatgaccctaagatcctgcccacacatttcttcagtggccacaaggagacctgtggacagtggagaaagcatcctctgcgcagatgcctggggctgggagggcctggtggagagtgaggtgacagcttctccttctccctcccttggggtgtctctgccctcgtacttgccctccagcccccacctacacctccatggatggtgactcatgatccagaccggctctggggagttctctagaaggaaagtgatcctggcattgttggggacacctcctcttccctgtctcccttcatggagagggcaggtgtcccgggcagacagaagaccctggaatccatccgtgggaaggaatgcccccttccagccctgttctcacacggtgctcagcctttcctgcttccgcatgtggcatgaggcaggcacaggaccctccacaggaccctcagccaggcacaggaccccgacagcctctggacacctggctctctcaggatcctttgaaaatcaaaggtttttctcacagtgtctgcattgcaatggaagtcatttgagacttggagttaccctagagacaccaagggagtctctcggttgcacccgctcattctgccaggcgcactgggtttaaacaggaggaagaaatcgtttctgactttgtagacactgcccatgtagcatggtttcaggctctgctatgattgctggtcagggagggctgtaaccactcagggaggggcaggtaggtggccggcggcatgcagaggttatcagctaagcaaggccagaactggtcagtgagtaatgagaaagctaagcttcttgctcctaagctaagaaggtggtgtgaggccagtctgggggcagggctggccacctacctggggcaacttccaggtggctctccctcccatctgtgtggtctctgcttgtagtgcctttcgctcacctgaggacacacactggggacacaggcaccttccccattcagagccaggcagcctctgcaccccaccaaacctgcctttggccgaggtacctgcagcctggccccgtcctgtgctccagtttctgctgggacccctattctgcccctcgtcaggcctacacgggatcctagaggaagggaggagacccctgtctccctccttgaagggaggtggaccccttcctcctccaggctccctgacagcccctctaatggagtgtcctgaggcttccagagcagtaccacaaactaggtggctaaaagcaacagaaagctgttctctcacagctctagaggtcggaagccccaagtcaaggtgtggacaggtttggttcctcctgaggctgaggggagtctgttccggggctccctcctggctttggtggctgccggcatcctcagcacccctcggcttgtggatgcatcactcctgtcactgctccgtcctcacatgggcttccttcccctccacatcccggtcctccttctctgtgttgtaaggatactcatcattggatttggtgcccactctaatcaaggatgatctattctcaggatccttacctcatatctgcaaagacccctattccagataagaccacaagcactggtgccagggctgggacttggacagatctttgagaggtacacaggtcagacccttctgccattgaatgcctctgaacaggaagacaggacactgtcctagggaaggccagggcagggcgagcaagctgggtcgtagggggacctgggggcagtgctgccctgcatgggctgggactaaggattctctatgtaggaattcccttggcaagaccatggtgccacccagattcctccctcggcccccccactgtccccagagagcacagcgcacccctgatgctgaccgttcctcgggtcatctccttgcttaaaaaacccttgaagcttggagcactttggggtcttggggggaggggggcaccctgtgactcccggtcctcttggcctgctgctctgtctgctgtcatgggaccaattttctttagggattaatctccagttcctggggacgctctttttaaataagctctgtttcatagcatgaaagattttgtgtgggttttttttaaacaaacacaataataattaattcaaggtctaagaataaagccaggtctggaacacggcctgactacagtgtgatgctgaccagcctagatgcaggccgtagaaggctccctgagctgctgggaaggggctcttgaaaatcacctcagggcaggggtcccgggctgccaggctccctcccatgacagtccaggtaggcacagcacgttggaggccaaacagccaggcagctggcgaagcacaggcacctgtggatgcagcctcattttgcttttctctttcccttggatggagtctctgtctcctcactcctgtcccctcttgtctgtttccaggatgtctcctcctcggcgggatctacccccacggctgtcccacgggctgcctcggtgtctggagagcagggcacgcctcccaaggtccagctgcccctcaacgtgtgagctgccctttgtgtctgtcggggtcctgtgcctgcagccctccctcctgcctgggctgacctgtccacgtgtggtttccgcagggttttcccatgtgttactagttggccagtatagttatgtgcgtctaataacaccgctgaagggagagtgtggaagacaaaagtctagcggttccttctgatgtcgttgtttctaggacatttcttctaagcagggaggatattcagagtattcacagtgcagttcccagtcaacaggagaggagccagccatagtgtggagcaagctctccatagcatggaaggtccgagattgaggggagaggcgggagggaagcaggtgcgcagagcagcgggtagtctaggagcttgggtagccactagtcaccaactgcttggaagtggttctgtgtttcagcccccgtcccagggccacaccagcgcatgccagctgcatctcatccccaaatataaccagatgaatcagtgctaggaagtgagatgtttatcttgtttagaaaatctgcccagttaaattacagctcttaacagataagtgcaattttaaaattccccatttaaatcatgctctgaagaattagactcccttttgctcttgtgtttggcagagctcagtcacttgaatgactgtgttagggtgaagtctatgaacttggcaaacaagatgacataatacagaaagttctgtgaatgcagggtgggtagacgtcagagggacactcagaacctgtgttgttacagaacaggattttttgttgttgttgttgtttttgttttgttttgttttgttttttgagatggagtcttgctctgtctcccaggctggagtgcaatggcgcgatcccggctcactgcaagctccgccccccaggttcacgcaattctcctgcctcagcctcccaagtagctgggactacaggtgccagccaccacgcctggctaaatttttgtatttttagtagagatggggtttcaccgtgttagccaggatggtctcgatctcctgatctcgtgatccgcccgccttggcctccctaaatgctgggattacaggcatgagccaccgcgcccggccaaacaggatgtatttcaagcaaaaaagtattttgaagagcaacttgccaagcttcaaaaggtctagaagtagctcagctgctggcacacactcacccacctctaagcccagtggaaacaccagcctttcttaagtggtgggcaggaaagctcccaatatcctcctactataattaaccaatgtaatgaaaggtatttgaaatgtacctattttttacctagcttcctgagcaggctacttccagatgccttgagactgatattcaagttttcaccagcactggacaaaagatactacctccatctcctgccatgctcctagctcagttctggcagcttcaggcaaagctggtgccaaggaggcacatggaaaagtggggggtgatggggctgctcttcttgaagaattggatgcaggatgctatctgaggaaagaaacctgcacccacagtgggatagccctgatggagtttcccaaatgagaggcaggatgcaggtcaggttgctgaggccatgagtgcttcaagggcaaagcccagatgtgtttgttttggagtccccgtgaccagctgaatgcctgtacacaggctctcagtagctgccacttgttctatgagagcaaaggcctccccttcctgggtgcagagggctccccagcttgaggcgagctcaaggcttagccacccaagaaggcttctctgtcctggagacccaaaacgtaacagttccaggcatgtcacccctcaagagttgtgaatattctggaggcctcaaccatggacaaacctccatgtcctggatggcttctaaatttggtgcagatgtggagggacctcttcttcacccagttcgcctgccctgggggacagggttgctgtgacctctagctctccaccttctccctctgggcttctcccccaggggagggcactttccactcagcttgagatttgggtaagagggaagggaaacttatgtgtcggacaacatccttctaaggatgacaaggatttaggtaggaatgtgtctgcaggtgacacagtggccctccatgcaggagctggatcatggtcagcatgacctgtgactggtgatggtccgttccatgtgtgttcatggctgttatactgagtagcagtcacatgccaggcaacattacatacgttacagcagtatgcatgatgcattctgaaaacatgacatcctttattttatccccagagaggaaaagatcagactgacctcatcagtttatgaggaaggggattagcctgactgctcacctatcctctttaactctaagaagctagtattcccacacataccctaccagtggcaagtacccggggtgggggtctgatctaaccattcttcccaaaatagcctctgtaagtcacgttcagaagtctgaaattgaacatgagatgtgctgtcgttgcaaaaacaaccacagcaaacaacagtgcactgctgcccattgcgggtctgcagagaatgatggcttggggactccagccagggcccagatggggctgatgtgaaagtcagccatggaatgacttcaggagacctcattcctgatcttcatgattgcatagctttgacctctccaggccacatcatgtgcactgaaacatgagcccttgagattaagaggcctaatcctgtacggtcagtgtgtcgatggctggatgttcttgccccttcttccagcatgtgaaaggcttccctggcatggattccctaagggctcagttgcccggaaacacaagaagggtctcagtttgctcacccagtgcatggaggcgactgtgagtctgcagagacgtctctcattcctgcaccccctttccaccccctgctgtgttgggctggggcttgtccgccattcctctggcagacctgctgtgatttgggaaagcagaaatatgattgtctgctcctagaggccatgctcctgggcacagccaacccacccagagggtctcaaggttgatgaaatgctgtgagtaggttgcccctgattttgaagggttgattctcacctccacttcttcgtgggcatcttagagccactgcctgatgtgaaggaccggaggaggcagggagagggcatagggctaccctgcaggagccatccgagatgtcctgtcatcacctacagcaatggaggaggtggaggaggaggacgaaacaggcatcagaccgacacgcctgggtctgactcggtccacgtacctgcaatctgagagcaacggaactcttggcacagagccttggtctgggactgcatgtcagcttgccatcagagaaggaaacttccacagtcgatgggtgcagttcattacctgcagggaaaactaggtaccctgtgaggtgcatgaccacccagatggcacctgagggacctgggagtcctatccaggagcccagagaaagacttagggagatggggggttggcctgcaacagggaaagggaagcccaggggaatcgtggccagcggttttcatcctcccctgctgaggtgcagaccagggtccctggatctggtggttgacactggtcatgtgagacgtgctctctgtcatggcagggatgacctcgcagaccttgctgtgatcaggagtgaccccctcatgaccccgctgccatttgtgcgtgtggtcaaaaggccaccaaaccatcctcaataacaacagtccccacattctgggacacaggaaaaggactgctgaccaaaccatgccaacacaagacaggggcaccttccattccaaattcacagaacaggctggtgctgcactcagcctgcaatgaactggatcagcgtgagttcaagacaataagactcggtaaaataagtccctgccaggcttggaacgaaggcctggatcagcgaaatcaccgggtactgcccccaagaggtgtctcagaggccagccgcccagcctcctttgacagtgcccagccttgtggtcagcctggccccatggtcaccccttccaggcatggcggcaccgtcctcaggatattacagacagatgcgaccaagaatatgagagtgagcctgagaaccagtggaggggtgagtactcttcatccccacccctgccgcctgcacctctagagagggcacagctgggaccccaagcaggtggggaaatggaggagatgcaagtgggaagagcagagaattttattgagagagtctctggatgacatagaccctggcgggcaaaggtcggagacgtctgggccgctgcagggccggttgcagtggagggaaggagctgcaggccctggtggtggcagcacatccccaccggtaccggcattgtctaggctgggtttcctggaggcaggccctgagatggggaggtttgtggggagtgctctcaggacacacctgcgctgtggctgaagggaagcctgtctgatcctcggggctctggagctgagacagccctgcggagtttccccattggaagtgagccagcgctggcttcaggctgccctttgaaggggcagtcatgggtgatgctgcaccctgagggagattcccagtgcagccaccacagtgagtgatcagccactcatcgcccttcagaggggacccaggctgggcatccctggaccctgtccagtggtggggcttcagcctcagaatgcagcagaaacacaggcaaacctcatttcatcgcacttcactttgttgtgcctcacagatactgcattttttttacaaattgaagcttcggggcaacccagcatccaccaagtctagtggtgccattttccaacagcatgtgctcacttcgagtctctgtgtcacatttcggtaattcttataatatttcaaactttttcattatatctttatggtgatgtgatcagtgatttttggcgttactgttatggagttgttttgggcaccatggaccatgcccacataagacagcgaacttactcgataagtgatgtgtatgttctgacggctccacggacccaccgtttcccccatctctctttctctccccaggcctaccttttcccttagacacaacaatactgaaatcaggccttttagtaacgctaagtgacctctaagtggtcaagtgaaagctagagtcgaacatctctcactttaagtcaaaagttagaaatgattaagcttggcgaggaagtcatgtcaaaagctgagataggctgaaacttgtgccaaacagttatctaagttgtcaatgaaaagaaaagttattgaaggaaattaaaagtgctactccagggaacacacgaattataagaaagtgaaacagcctaattgctgatacggagaatgtttgagtggcctggatagaagatcaaaccaactgcaacattcccttaagccaaagcctaatccaaagcaaggccctaactctcttcaactccgtgaatgctgagagaggtgaggaagctaaaggaggaaagtttgaagctagcagaggttggttcgtgaggtttaaagaaagaagccatctctgcaacataaaagtacaaggtaaagcagcaagtgctgatggaaaagctgtagcaagttatccagaagatctagctaaaatcactgatgaaggtggcgacactaaacaacagattttcagtgtagacaaaacagccctatattggacaatgatgccatctaggactttcatagctagagaggagatatcaaggcctggcttcaaagctttaaaggacaggcagactctcttgttaggggctaatgcagctggtgactctaagtgaagccagtgttcatttgccattccgagaaccctagggctcttaagaattatgctaaatctactctgcctgtgctgtgtaaatgggacaaccacgcctgcatgatagcacacgtgtttacagcatggtttcctgaatattgtaagtccattgtcaagacctactgctcagaaaaaaaagattccttttaaaatattactgctcattgccagtgtacttggttattcaagagctctgatggagatgtacaaggagatgaatgttgttttcatgcctgctgacacagcatccattcttcagctcatggatcgaggatagtttagattgtcaagtgttcttattttaaaagtacatctttttctttctttctttctttcttttttttcttgagatggagtttcactctgtcgtccaggctggagtgcagtggcatgatcttggctcactgcaacctccgcctcctgggttcaagccattctcctgcctcagccttcccggtagctgggattacaggcgcatgccaccacgcccagctaatttttgtatattgtatatttttttagtagagacaggttttcgccatgttggccaggctggtgtctaactcctgacctcaagtgatccgtccgccttggcctcccaaagcgctgggattacaatcgtgagccactgcgcccggccaagcagtacatttcaaaggttatagctgccatagatggtgattcctctcatggatctgggcaaagtaaattgaaaaccttttggaaaggattcaccattctagggccattatgaacatttgtgattcatgggaggaggtcaaaatatcaacattaacaggagtgttgaagaaggttcttccaatcctcatggatgactttgagtggttggttcaagacttcagtgtaggaagtcaccgcagatgtggtagaaacagcaagagaactagaattagaaattgaacctgaagatgtaactgaattgctgcaatcttatgagaaaacttgaacagatgaggagttgctccttctagatgggcaagaaagtagtttcttgagataaaaatctcctcctggtgaagatggtgggaacatcattgaaatgacaacaaagagtttagaatagcacataaacagttgatgaagcagcagcagggtttaagaggattgcctccaattttgaaagaaattctactgtgggtaaaatgctgtcaaacagcatcaaatgctatagagaaatctatcatgaaagaaagagtcaatgtagcaaacctcattgctgtcttattttaagaagttgccacagccacccccacctttagccaccaccaccctgagtagtcagcaactattcacatcaagacaagaccctctaccagcaaataaattataactccctgaaggctcagatgatcattaacattttagggcaataaaatatatatatatatatttttttttgagacgagtctcgctctgtcacctaggctggagtgcagtggcatgatctcagctcactggaaccttcgcctcctgggttcaagcgattctctggccctagcctccctagtagctggggttgcaggtgcctgccaccacactgggctaattttcgtctttttagtagagacggggtttcaccattttgtcccagctggtctcaaactcctgacctcaggtgatccacctgcctcaggctaccaaagtgctgggattacaggcgtgagtcaccgtgcctggacaaagaaaatatttcttaattaaggtacttacatttttttagacataatgctatcgcatacttaatacgctactgtatagtataaatataatttttacatatattggtaaaccaaaaattcgggtgacagtttattgcaatatttgctctattggggcagtctggaaccaaacccacgagtatcccacaggtatgcctgtacctggagggctgttgaaacacagattgctgggccttacaccaggagctccagggtgaggccccagaatctctaacaagttccaggtgaggccagtaccactggcccaggttcacacttcgggagtccctgcacactagccccacacacaagtgtcaaaggtgctcagttgggaaagacatcagctcctaagctggcctcacagccgtgccaccccagctccttccttccatgaactctgtgacacttggttctacctgggagaaccccatctcaacccgcgtaactgcctgtgggatcccaggaaatcagaaggccccagggagaaccgagcagtttctgctggctgggctgagccagaccatgatgtcagccctcagggaagaggcgaaggcagcagtgctcccggagctggccatcctgaggccatacctgcagctccccaggtgctcgcgcacgctcctctgagcatctgcactcatcctcgccctgcctgcagctcctggtcgcctctgagctcctgagcctgcttcagcccttccacaggacttacccagccctccccagccccctggcctccagtgcagcccctgacagcactcctgctgtgggtcttccctgcagagtgggtgctgcacctagatggaagaggtgaggaggaagcacacgcctccctaattcgagccagcgtggccctgggagaaaagtagaagtgggacttctggtaggagaactgggaatcatttacttattttagaagacgtatgagcaagccaccatctagaggagaaaggggatgaaattagcgaaggcactaaaatactttggtttactctgattagagcggaagagaaatctgcagacaattagcagcaagtaaagatcttgctatagaaataaggaagtagtatgggtaagcgaaggctgtgctgttagtttcaacaggctgcacgtgaaagcagacacatgccatgcccagctgggtcagccgagtcggcccagccgccagcctatcttgtctgtgcaccgtcccgggtgtggtgagcccctggccccatgcctgactgcacacctgccgcggccacttctgcctggaggaggctgtacttgtcctcagcaacctgccctcaagaggcgctttttctcattggcatgaaagccctatacacgctaccaggtggtggtgaggaaggctctctgatcctaaaatcccatgattgccttaaataagtatttgaagtaccaacctgtgagaatccgcagaggtgatgtctgagcatgcagggtggccttggctggtctcgagtgttatggagatgccctgagcactccgcagggcctgtgttgagctgccaaggtgttttcaagcaaatggaaggtgagagttgggctcaggagccaggaggttgtgagccctgctacctgcaggtgctgcccggttctccctgccatgccagacccaggtgcatgtgtctacgaagactggctcgccactgagtgcaggggacgccatccagctcagccaggagactctgaactggcagtcctgacaggactcaactcacagacgttggtgagaaacagggtaacaggcgatgccactgtggctgcagggggcagcggcagagaccctgagaggtgggagggaggcaggttgggaagggccggtctcggcacaaattgctcttcagtgtggtccctccaaggcctcctcttgagtacctcagagaggacagcagatgcagttgacccccacccgggccaaggcccacccaacacgagccgcatgccagaaaacagacccagcacatccatctgcttttggtgtcccctacgaggcacccagaggaaaaaaagtaggcagagaagagatttttcaaagtgaagctaggcttatttacattccagttcccccagcaacctacacctagaggccgaacttaaaatagagatcagagtgaaggattactcatcaacagaacgaacttaaaatttaagatgaagaggccaagtgcactagtgccctggtgcacgtcagggcagcatctccctacgcgttggccacaccgggcctgtgcttggagtgaggagccaacataccccattcaggaccccagcctccccgggccacacctctgtgcaactgcagctctcatcttgcccaagccctgccccagctgtgccccaggccgcgctgacagctccagcagcccagccctggccctacccctgaacatgcgtgaccatggacagaagctccatcccctcgagcttttgtgtccgcagctgtgaaacatgtgcaagaaggccacagacagccctggggaggaagcacgttgcacagggccacccgagcagaggtagccctgctaggggttccatgctcccaggccaccaagctccacgctgtgcagggagcctgcagtagcctggagggagaagtggcccagccccagtcagcgggtgtagccgcagccaatccacggaacaaggcctccacagagcacagcccaccccacacaggccactgagcccctagctctgcaccttgcctaccagcccaggagcaggagggagaggagtccgtgagctgtggtcagcagctagggcgtgttctgagcctgccttggcagctgatgagccccccactccagaggaaaggcagccccggaccccagaaccaactaaaaggagctgttggtgcggcctgagttgcatactgttgcccatggccaggagccaacccggctgcgcattctgcatgtggccactgaagcaaactgttttgacaccataaagcaacagatgaggctaacttaagcaggatttacactcaattgtatttctctgagagcaggcacatcaatttgtgcgtcattgttactgattcacaagccttccacggatccaagtcctccctgcactcttcctctcctcttctgccttcctttgcctcagcccaggctgtgtggaagccaccctcctctcctctccccttctctttcttcctctgtcctctccccgtcctctcccatcctctccccatctcctcctcctccctcctcctccctccatctctctcatcccctttctttcacctctccccgttctcctctcctcccctccagcttccctgcacaatacacaggtacgtgttggctgcagttgtttgtcattttcactggacttttcccttagtggtatttcctctatggtgatgggaacagaatcacaccctggtttctctccatttgtcacctagacatagcattgaaactgtgaacgtggtggggtggcggggtcctctcctgatgattttgtgtatcctcctgaagcccagagttggtcctaatttcactgtcagtgttcaccatttcaaacagggaaagaaacaaagatgccagccacagttggagcccacagcatgtccctaggaggagggcatgagggacacctatcaacaaaggaaatagccaaggtcattgaatgagggcagagggccttgctatgtaggattaggatgttcgaaaaggggggcagatttcatattaaggccaagaaacttttaatctctacaaggttctcctgctattccagaatattccacactggttcttttttcctgcttgagccctcgtgagctgcattctgtttctgttttcacttctaagtggggttcctccagcatcaggagggtgcaatggtggggtctatgagcttccctcatatccccagagatgcactgtgtgcacaagccgctggatagggtcagcatccccacccagcagcctgcactggtgtgaggtccaccagatcactcttcattaacattcatctttggtctcttagtgaactgaggcctccaccagcttccgtggctgaatcttgtgagcaaataaaataatctggtatgttctctccctccgttcaaaaccaaccttccccaaatcccaaaagtagcagagcacttttgtaagtattatccaatctttacaaggaaaagatataggtatagttaagtattttatgagagtagcttggcccatgggctgagttagaggcacagcatctaaaccctaagctgggattttcaccactaaatttgctctttccttatttgcaaataagacttaaaattaaggctggtgtaatcccagcactttgggaggctgaaatgggaggattgcttgagactaggagctcaagaccagtctgggcaacatagtgggaccccatctttacaaaaaataaaaaacttagccagcatggcggtgcacacctgtggtcccagctgcttaggaggctgaggtgggaggatcacttgagcccaggccattgaggctgcagtgagctatgcttgtaccactgcactccagcctgggtgacagggtgagatgctgtttcaaaaaaaaaaaggtcaagtaattaaccatagcacaattactgcaaggaagtgtgcaaccacagttttctaacttaaccacctttcccttaaaaagggcctctgaggtctcttccacctctggttgattggataagccaggcaggaaaaccaggccaggttatattaagtgaggaaaacccagcccaagaatagcttagctcaccctcagttttccctaaggtttcccttgctcagagcatcagactttagaagaggaaaacactggaaatccaaagagctggccctgggatgcagttcagagagtccttgagggctttggggtcactgggccttagggagctgccttcctatctgtcagatgggcaggtggaatcctcctaaggctgtgggtgacaggcacacccctcccctgcaggcagctccccgaaggctccctgcctcgtgggtttgttatgaggagtgagctggggagggtgtgtgaggcctctgtaaactgcagagcccccatagactctagtgggtctttttaggttgggttcctccaaagacaacctccccccaggaatgccggccggtcccctatccccaggagggctcccactgacactggccccatgctttgcccgcaggtacctggcgctctacgcctacaagccccagaagagtgacgagctggagctgcacaagggagagatgtaccgggtcctcgagaagtgtcaggatggctggttcaagggggcgtctctgaggaccggggtctctggggtgttccccggaaactacgtgacacccgtttccaggtgagggcatggtggtggcagcctgggcaaggagagggcaagggcctgcacgccttaccgctgttgttactgctggaggctactctgtcagccgggcccagaaggcagcaaggccaccagtgcccagggttcagcccccactggcgtccccaggcccacatttcaccttctgagctgggtttgcactcaactccttggctgtcctcagcagacattggccaccaaggggagaagaatgggatcaggaggagcagggacaggaaagtcaccagaatgaggtctcaagtgtgaatgtgtgtttgtgtgaggacagtgtgtgcacatatatacagtgtgttcagcgtgtatgctatgcgtgtgcagtgtgtgcacgcttctgtgtgcttgtgtgcatggtatttgtgcatgtgtgcagagtatgtgcagtgtgcgtgcctgtgcacgtgcgtatgcatactgtaagcacaaggtgtgtgcgtgtgtgcataatgtaggtacagcatgtgtgtatgcagtgtgtatgcatgtgtgtgcagtgtgtgtcatcatatatagacgtgtgatatgtaaaacactatatacatatatgcaaaggaaaaatgatatcttcccaaaggtcaacgattgttgagtggtcgcattgtggtaatatatttttttctttgtgttgtcagtgtttaataagttctcagttctactacttttatcaaatagaatatgtaattttagagtcactgaagagacaagggggttgtctgggaatttttcgctgagatgaggatccacagcttggtgatatcagtcagcctcactcacagaagcccctcgtgggcacggccctgtgttgacactgcaggacacacacacagaagcgaaagacgtggccttgggtttctcctgtctttggaacaaggctacagtggaaataaataacctgtagaccctgcattgattgctgggctgattgctacttgcagagtggtctcgggacacatgcggtgttgacttgagcagctctagttcgcaaggcaatcttcagccagggcctctctcgaggtgcccagaagcgggggctaagggatgatggagttgcccaaagcctgaaaggtctgcaggcacaaggctgaaggggcagttagagatccttcgctcaggtgatgctcagcagggaaaagcttgagaagcaaactgcagaggggcttcaggaaatgcaccccctcaaacccagccacctggtcagaggggtggctacttagagggtgagctgcccacagcctcctgcggcttcttcagtggtgtggggtgacttgcccagtgtgcgcagccccgaagaaggtctctggtctggatttcccatgccagtaggaacaggttggctctctcagcctgcaaccggcctgtgcttgaagcccctggcctggagttgggctcacctgtcgtgtcatcagatggctcttccaggaaagcacaggtcacccctctaggttaggggactccctgaccagctggcaccctccaggaaggcgcagcctgagatggcgggtgtccacacctctgggctcgcccgccctgctgggggacatcactctgtcacacgccctactgttatatgaggaggcaggttcttcctccatgcagcaggttagagcagcagcttctgagggaggccatcggcttcccagtttccagtttctctcctctgattcttcctttatctttacctgagaacttccgcagaccttcagagatgtaaagcctgcggttgaaatccagcttccttgcgtagcattgggacatcgcctggccgggcaactcctgacgtgtgtcagtcagtgtcaccacagggagctctcttaggcgcctcccacccccacaacactggactgccttccaccctcttcctgcttctgagttaaatccctgaatatccttcaagagctgggtcctaagtccacttgctatatgaagccttgcctggaggccctcatccttgcctgtgctgtagtcgggatggacagctctgcccacggtgtcatcccaagcagcccactggcaagttctacaggcattcaggatcccccctcacaggccagtccctgggccgcaatagccatctccagccttgtttacctggctccttgcataccatgttcatatacgaggtgctcaataaatgcagatcgaatcaataaaagaaatctagttgttctgatcaaaatgtctcctcaagaactgtcttctcctgctgccagggagtttgttatgggaagatcctccagctcctgacactggagcacttagagtggcccggtcccctccctctacctctgctgtgcacctcatggttgctcactctcctcaagccctcttggtctgtgttttccaaagaatggcagagccaggaataaacattaaggaaaagccactccaaatctagccccggtaactgcagtgtcaggaggtcattgagtgtcctctccggttccttagagaaggaactgcgcccgggtcggctgcccccaggtcagtatgttgaaggccatgggtccctcagtccaatccatagctcagcacaaaacaggaaatctggcctcggtctttatccccagaagtggaagacacctgtccccctccaaagctgtgcccccaggacttatactttcttgatccctactgggttcaggacaattgccaaagccacacagcagaaggcttatctggcagtgattggagggtaggcgaaggcctactccttcctgcatagacctggatccaccacctgtgtttgcccccatcgtgctaggaggccctgaagtgctggtgggctctcggggctgggagtatagtgctcagagctgagcattgtgagtccatttaaaaacctggtgtgggagcaggtatgtggctcttcccgtgagggcacgcactaaggaagtaggactagccaagggtatctctgccatcctgccatgagggcagagggaaagggttttctgctgtcatgagaggcagatgtgtgtctgtatctgttgtgttcagacttgtcaatatcaccttgcaaattagtgactcatcatttgtgagcccactttatttagtttttaaaaatgatttcctcggggaaaagtgagctcaacagatgatagaaaatgggatttttaaattcatggttttggctgacctgctaacaagcttgattgctgggtgaagttcagcacagctctgagggctggggaaggaggacaccacccagggtcccctagcaggtgagtccttttccaagaggcccctctcctctcagctgctgtgcagaaaccctcactctgtgttgccgggagcttccctgctagaggtcgtgcccagtgataccagccacagggagatggctggaccaggcacaggagacggggcaggcagcctgttctcccacctgtggcttcttggtgtgtcttgaaataagatcctgaagggacagaaacaggaatttacccagctcttggacaaatggaagacatttaattcccctgaaactgaatccacagaagcttccaaacccctaactctgccatatttcacatcgctgcctccaggacatggattaattgcaaatacacagagggaaagcgtgaaaagccccatttccagagtgttcctcttgtgtgagctgatgtcatctggaaacttcggagtgaaagggcatctatttctggtatggaactgcaagctcccagacattctcagaaggatgtcgtgctgtgtgtgccctttcccagcagccagcagatgcgaggtggcagtcgtgcccagagggggcccgcgtccttgccatcctttccccaatgtgctggatgtgtcaaggcctcgcgggacatgactgagtcatctgttctttctggatgtatctggagacacacagctgtttgtaagaacaaattaaggcagtagctgtggtataaaagatttcgttcagctcattcctctgtttctcagggcggctttgctatctcttaaatatttcacactgacagtttgcaccccatgaaggttttgtaaacagggcccttctgcccagtgacgggcattgttttaggacctcgtccccagatcagttggccttcatctcttaaagccagcaggtcagagcgaggctctgccagaggcccacatggcacgaatgcctctgagcctctcatcagaattccttctgctttctctccacagggtgcctgcaggaggggcagggccgccccggaataatgtagtcggagggtctccactggccaaagggataaccacaaccatgcacccaggcagtgggagtctgagcagcctggccactgccaccaggcccgccctgcccatcaccactccccaggcccacgcccagcaccccacagcctcgcccccaacaggcagctgtctacggcactcagcccagccaacggccagccaagcccggagcaccatttcaacaggtaccttcacaggggcctcaccctgcagggcatcaacaagggggcttcctgggacatgcttgtgagacacatcttggcccaaggctccagcagtgcatgtgtggctggtggcagcttcatggcagctggagaaacttaaggaaaaccggtttggccccagaatgttgtgagatgaaaagaaattatggggtgggccttaaaggcataaagaaggtaagcacatcttgtcatgctcgtgaacgtctgatctccaggaagttcacttgccttatcatgttacccatcctggcagctgaagtaaatttacaaatatttacacatttcattgtggcaagagggcctcatagactaataagattaacaccggcactttcaaatgcctcccccatgaatgattgtgggccggccacgtgggtcttccatctgccgggccctgcagggcttcccagctaggcggcatctcacaggacagggctggggtgagactcgggcccaggctcttccctttctgaagtgctctgaggcaggaggaatgacagctgttgatccttcgccttcatggcagctggagaaacttaaggaaaaccggtttggccccaggatgttgtgagatgaaaagaaattatggggtgggccttaaaggcataaagaaggtaagcacatcttggttggtggcttagtgttgagctaataagaactgctgatgctggattcgcaggatgatctgggagcccatgccacggcgtcttccaccacggtggagccagtgatgctgacatgatgccaagtaccccaggacaagaggggataacacagaatctctcttcccaccccaaccctgtcctctcagaaatcatctgtttttctcaaagtgaggcttaaagggcaaaaataatgtaaattcatggaagcaataaaatatactatttcttagactaacgaacacgatgacccattagaagtgtccagaaagcagcttctcaagtgtggaaagaggagacaacacttaggtcagcagaggccatatttccttccttatcttagctgatgggacaaggggtgggaggtaagtgtctgtcatccacttgcccacccaagtgggtgcagggtagacttcaggtatccagtgcccagcatcgtcactgggtgcaggtggactttgagtgcctggtgtctggcaccatcagcaggtatagggtgaactttgggtgcccaatgtctggcaccatcagtgggtgcaggtggacttcaggtgcccagtgttcagccttgtgctggtggtgtacctgtcaagcagtgggtaatttagcactaggaaagcttcatgggtggtctgaggactaccctggtgtcagagccttcaagacctactctgccatctcagattctgtaagtctctactagtatcttttttacttaaatcagctaagaatgattcttggttttcacacccctggctccagggccctgggaaagaatctgcagcaatattacctggtgcccaagcccaccctgcaacccatgaccttctgatcagccgtccttcagcatggtttacgtggatctgtgttttctggtagcctctagctggggatacagtcattgcagttggcaagtgatctggtgatctgaagttgtgctccctgactggtcagaggcagccaatatgctgatctgtttggccactggagcacccaggcaggaccaggggagcaaaagtcccaggccaggtcccttctggttataaacatctcatccaatcagcccggtgttctgtacaaatgtttccacatgcaccagcactagaaagggtgagtggccccactcatcacggtgagtcagcatcccagtgcagtggccctgggttgtctgcccagaatagccagtataatggtctttccacaccaagccttgctagaaacgttcccaattcaaagaagaaatggagccctgccagtcacttctccctctgtggaataacaagcaggatcaaaagaaattggcaaggctgtggggcagtgcaacattgtgtctcagtcctccatcaccatagtaaccatgagggtgccacgagcattctcttccatcagtttaatgttacacacggggagagtgaggcacgggatggttaaacggctccccagtgcatcccagcccagcacttgtccccacgctattgctgtcacagccaggttaaagaatgactcctactgagccatatcagtaaattaaatgccactgagttcctgcggcattttccacttcattctgcatttagagagagaaaaaacactgttgacagtccaagtaatggattgttccctgcagtaattgcccatttcagcagaccccaaccccgatgggtgggaggcatttcatcaatgttctcatctcgagccaaagtcaggcagtttgacaaaggcttaattgcattggccatagcatccaatatgatttgttctacttgattaatgtaactcctttcccaaaggcagagcaccccctgtaaagtgccagtgttccttgcacactcctgtctgtgcttagcaggagtaagagcccagcatagccatgaattcatcagcaaaaaagcaccgagaaggagctagatacaggcaaggcaccctgcaggggtctggaaacagaggaaaaccagacaagccccatttccaccccggttagagagaatgactagaaaacaaagttctgtggtgggtttgctaaagggctgcaaaagaggcctgcttaggtattaagagagtgtggaggagggaattcattccgactggggaggaaaataggagggggattgggagtagggcatatggaaagttttcaagaggaggtgataatgccttgaatcttaaaggacaaataggaagtgtctgagcagacaaaagagaaaggaggttcagagcagaggaaccagcatgagcaatggcctggcaatgaggaatagcataactcttgttttggggaactttatttagttgtgacatgactgaagcaaagctatggaagaaggagaagtccagtgtgtagatgacagttccctgcagaggcatactgtcctttaaatctgaaaggtgggtagagctcagcatgcagcagtaggagagtgtgggaagcactcaggaaggggaagcatggggagctcttgggccgccgaggccaggggcccatggacgctggaatacggatagggtgcgggagcaaagaaagacccgcagtgaagccgaaaagctaagcagagcagagcatggaggttcttctagaccacgtaaggaatttagatgtttatcctaagggggcacatcaaagggtgttgaataatagacatagtcatatttttgtatttaaaagattgagctagacttctgcttatggccaatctgaagtgatgaggacaggaattactctcccacatgaaacaaatttaaaaagccaagtatataaaacaacagttttcaagacaccagacaaccaaggactgattcatgagagaagttgcaggcagtggcaaaaggaggcaggtaaccaggtggaggagccccgaggatgtggagatcagagtttgtgtgacagagagggcttgagtttccagggcagtgaccagagaggagagaacagcacagagaggctgcagagcacgccctgagatcttcaggtgacaactcatctgcatatgaacatgagaaacgtacccaaagccaggaaaagaatcaaagaaagaaaggattagtgctaacagtgcccagaatacacaccagctggaaatagtgcctgttcccaccagccagacggaaaaattgcagaaatcaccaggcattgagtaatctacacaggaccttgcctctgtagtggtcagactgagcactgttccaatttcacccaacagagctcaaaaacaacactcaagagtcaaactatttctgattaatttatctttgtcccagaacaaagcttaagaatatttataggaatacaaaaaaaaaaaaaattccagctctcaacaacataaaaatcacaatgtctgatgtccaataaaaaattatgaggcatgcaaaggagcaggaaaatatgacttataatgaagggatcagtcaatcaatcaaaactgaccccaaattgacatagatgttgcaaagacatttaaaaatgatattacagttgcctttcacatactcagaaagttaagtagagacataatagacccaaatcacacttctagaaataaaaactacagtgtgtgagatcaagaatatactagatggaattaatggcagattaaacattgctgaagaaaaaatatttgtaaacttgaagatatagtaatagaagccgtggaaagtggaacacagagataaaagacaattttgaaaaatgaatggaatccgtgagcaatgggacaactttaagtggcctaatatacgtgtaattggaggtctccaatgtagaggagagaggtaggacagaaaaatgatttgaagaaataatgaccaaaattgttccaaatttgatgaaaaccacaaacacagtttcaaagacagttggtgaacaccaagcacaagaaacatgaagaaaactgtaacaaggcaaatcacaatcaaactgttcaaaatctctcataaagaaaacactgaaaacagccagaggacaaaaagatacattacatgaaatagaaaaaaagataagggtaaggatgatgtcaagaacagttcaagtgagatgacagaataaccaaaaaacatactgaaagaaatatagctgtcaatctagtactctactcccagcaaaaatatctttcaaaaaaaaagcaaaataaagaattattcagaaatagtaaaactaaaagattttgtctctaataaatccacactattggccaggcacagtggctcacgcctgtaatcccagcactttgggaggctgagacgggtggatcacgaggtcaggagattgagaccatcctggctaacacagtgaaaccccgtctctactaaaaacacaaaaaattagccaggcgtgttggcgggcgcctgtagtcccagctgctcaggaggctgaggcaggtgaatgacatgaacctgggaggcagagcttacagtgagccgagatcgtgccactgcactccagcctgggcaacggagtgagactccacctcaaaaaaaaaaaaaaaagaaaaaatccacactattagaaaggtaaaaatgaaattatttagaaagaaggcagatgataccagatgaaaatgaagatctatacaaaggaatgaaaagcactggaaatggtaactacatagataaatatataagatgttttcttattatttgaatatctttaaaatataattgactgtttaaacaaaagtgaaagcaatctagtttgggatttaaaactcaaaagcaaaatgtacaataaacaaaaacacaaagtttgggaagggagaagtggaagtttggtatactactgtaacattcttatactatgaatctttatgttatgaaatcatttgtaaatgactataataaaataaagatgtaagcagtcactaaatatgaaacaaaaagttacagcaaataagctaaaagggaataaaaaggaatcatgaaaacatccaaaagaaagcattaacagaagggaaaagaaacaatacatgggtcaaagagaaaacatatagtaggatggtaggtttaaacctaatcatgtaagtaatcacactaaatgtaaatggcctaaataaccctaaatataattcagagattgtcacatattactaaaaacaaacaaaaaaccaacgatatgctgtgagtaagaaacatactttaatacttcaagtctaaagacataaataagctaaaagtgaagggatggaacaagttatacacattctcattattcatggtagttacattctatgaagttatcatgaacactgaatttgtgaatactgaactattgcttctaggtgaaattgtgtgtggcatgcgtgcatgggtgtgtacacatatctcacataaattatcatcttattctagtagattctattttatttatttgacaaaagagaaaatgaggttcagaaggattaagtggctgacctgaggctgccctattaacaggtgccagagctgggattcaaatactgtccaactggcctcagagccaaaactttctgcattgtactgtgttgccccctatcggctctatcctcctgtcatctctgtgtgacgctgaaacaaaaatcgccttgttcaacctcagctgggaatatgagtgtcaggcaactcaaatttttgccattccatgaatgtctgaaaataactgaaagcaccacagataatgacttgggggttacaaatcgtttttcactagtagaagaatttgcaaatacagaatctgccaataatgagaatagattatatgatgctaatattaatcaaaagaaagctggagtggttatcttaatcagatagagcagaatttataaaaattattagagataaaaaggcaatttcgtaacaataaaggggtcagttcatttagaggacataacagttctaaatatttatacaccaagtaacagaacttcaaaatacataagcaatatggataaaggtacaaggagaaataaacaaatctacaattatggtcagagactttcatgtctcaataattgatagaacagttagatataaaatggtaaaaatttaaaacattagaacaacagtataatcaacttgacttagttgacgtttgtgaaacattctacccaacaacagcaaaatgcaccttcttttcaagtgcacacagaacatttactgagatagattatgtactgggccatgatatttttaagtttcagcacatttaaagggattcaagtcatggaaactacattccctgaccacagtggcattgaattagaattcattaatacaaataataacaaatatttgatatactcaaatatttgaaaactaaacagtttacttcaaaataacccatatattaaagaacaaatcaaaagggatattataacgcattttgagctgaatgaaatgaaaaagaacagtgaacttgggaagctaacactgatttagagacttcttaaaaaatacagtaattaagtttatgtgatgttgttgtaaagatgtttgtttttaatatttaaaaagtcaactctgtgggtctatataaaatggaacacacaatagccaagtgctgaagcactggcctactggctgtaggataaaaagcaggccttgttgggtgactttcaactcctgcaggagaatatggacaggaagcccctgtgagaatcaggggaccagagctaggtgtgccagttctaaaaattccatcattttccaggggatgggccatactaagcctccacctggggtgtgagagaaagaagagagagccccaaccctggtcatggtgctgagtttgaggatggctctggcctgaggactaggactagctcagcaccctctctgcaggaccagaactccaagaagcccattaaacctagttctaagggagggtcctagaggccaagcagcactaacaacagaactgccagacccagaaaagtagacaaagagccgcaagctcagggtgagctggcacattaagatttcaaaacacaaaagggaaactcacacataagttagccaataaactcaagagataggaggaaaataagggagaaatctgagagcatctttgaaatcagtatgtttaagatctaagaggaaaagaaggaataacatatacacacacaaaaaagaaaaacaggaagctatgaaaaaataggtggatggctatgaatcagaaacaactggatatgaaaaagaaccaatttgaaattttggagaggaaaaatatatatttaaatacaaaacctctgtaggtagcataaactctagacacagttgaaagtggaattagtgaaattggaaagccatacagaggaatttatccagaatacagagcagagatgaaaaatgtgaaagagatgtataaacatggaggatagattgaggagctccaaactacttctaacaggattttcataactagaaaatagaagagatgggacagagagaagattcaaaggagtagtccctgagaattctccaaaattgaagaggggctcaagtcctcacacagaaagcacaaagagtgctgagtaggaaaaataaccaaaaatccaagcctaaacatgctgaacttaaacttaaagcatcaaaggataaggaaaatactacaaaacctgccagagggcagatacagattacttacatagaaatgaataaaaatataagaaagagccagtgtacacactatttcaaaaatattaagtgtaaagaaaaatgggaaaaggaggtactagctaaaagaggacaaggtatagaaggaagattatttattaaatgggagagacaactggttaataaattatgggggaaagctaataaagaggctaaatatatgagagaagggatgagccagagaaggtatcaaggatgtgggtgaaggcgttgacctggtgggacccagagtccttgtgactggaagggaggggtgtggggaagtagagaggggggttggcttggagttgtgggagttccatttcatccctgaagtgggaagcgatacccctgaaaataaggaaaggacaaagctggtgatgcaatagatcatttattcattcccctatcatttataaagcacctacagatactagggacatagaatgaactgagtgagggctcacagtccttggaagctgcagcgggactgaaacacaccaaaagtttaaagaagagaggaaagggaaaagcagggaccatgggtggtgctttcctaagcagccttcatctgtcagcttgacttcaaagaagatgtgggctactttggcatcactaacgagtagtcccagccagctcggggttggggcacccggggtgggtgaaaataagggtaaatcctaccagagatgagcacactcttcaccagccagtgtcatgacctgagctgtgccttgctttctcacgctacagtttttcttctccagtggttccattctgtgaaatcggaagtgacatggctggggttcttttttcctcagagactcactcttttattcaaaaaatgtacagagcaccttctacatgccagggaccattgcgggcgttatcgtgaattaagcagccatgtccccacctcatggagctccgttgcacagtggggacaggcaatgaataatcagcctccagcgaacatgtaaattacacaactgtgaggagctaagagccttgggagcaaaggaaagctggagctagagcaggagcaggggaggctgaggctgcagggtcaggcagcaccgtgaaggtggtaggcaggtctctagaaggtggtatctgagccttccaggcacccgagggtcccaccttgcagctatgagggaggtgaggtctatgggcaggggtgctggcactgtgcctctgaggtgaccaggagccagtcctattggcagagtggccaggaggccagtgtggctgaggggagagtattaggaggtgaggttggagcttgctggaacacactccctctcttctttggtgcctgggatgagcaaagtagtgcggcaggcgaggggaagccggccaggaggtagaggccagccacgcacagcccaggggcacagaccctggtgcagtcccaacgccgagggccacagcgcttccctggcaggctgtcaccccccttccagggaccctggaccgagagaaggggagtcagacagctgaggggagagacgaataaatctcgaggagcggcctctgagtcagggtttccagggtgattaaatgacccgaggcccctggatctgcgtgattgcctgacctgctctccttgtaaatgtggagctgtgttgggttaggatcaaatgtttcaagtttccaacccagctgaagccctgaatatttaaaaaaaaaaaaaaaaaaaaagaaaagaaaaagaaaaagaaaacagaaaaaaaaaacccacataaatcagcctttctgtatttcacctcgtagaaacagcaggctgcctaagtcccggagaatctgggatcacataattagatctcaccagcgcttcacacacggctgtgtcagaagaaggcctgactcccagatggagagctttgtatgtctcacggtgctacttcccgtggcctccaaacgctgttaggattaacgagtgcatagttgggggctgagaagattgtttttattgcatgtattttctttcatgctctgaagccatgaatgccacaaagtctgctggtagaaaatgattacagtatgacataatttttctctgccttaagaatgcacagcagctggatgtgagctgcgtggtgctgcccgggccacttggtataaagcagtgtctgatgctcagcccaggtctccacttgggccagaacaacccaggacacaagtcaccattcccctggggccgttcattctctcccagcatttgtttcatccatatttattaaggagataattccctgaaattactaacacacatagtagcaggattactattaatgtggtgctgtgtttaaagggagctgtatcttttcatatgggagatttttgcaaatgttacaacttgcaatccctaacatctttaagaattgtttttgctggcagcaaggtggtggatccacagttgtaaggttccagttttgtaaacctggaagcccggtgcttcgacatgcaggcagagcagcaaatgcaggcagatggcagcagggtggtgggcggcttctcctccaggctgctgctgggagaaacgtctgctgctttcttcctgcaattgtccccagccaaggcagctctcacatgctcagccctcactcttgctgagtgacatacccagtgtggaaaccaaggaccagccaggccagttcgggatcaagagtaactagagtcaagcttggtcggcttgcatgcagtggtgcttaataattcaggggacatcttgaggcttcactgagatgctttcacaggctttatgtttatgagcattttacaaccatatttcaaaaccatattttcaaaatttttctgagtgcttcagctcatcacagcagagaaaattatttagagcaggagtccccagcctccaagccacagaccaattccggtccatggtctgttaggaactgggctgcacagcaggttgtgagtggtgggtgagcaaggaaaacttcatctgtatttacagcccctcctcaacgcttgcattaccacctgagctccaccacccatcacattagcagcggcattaggttctcataggagagcaaaccttactccacttacttgggatctaggttgcacgctccttatgagaatctaatggctgatgatctgtcactgtctcccatcatctctagatgggcctgtctagttgcaggaaaataagctcaggggtcctactgattctatgttatggtgagttgtatacttatttcactatatattacaatgtagtaataatagaaataaagtacataacaaatgtaatgcacttgaatcatcccgaaaccatcccctgcctcagtctgtggaaaaattgtcttccacaaaacgggtccttggtgccaaaatggttggggaccgctgagttaaaggacttcatagaactgggaatgtgcccatgttcatggcaaccttggcaaagctgttttagctccacctgaggaaaggggtgttttgagccgtggcagggccccctgatcccttgggctttggaagataggaatgcattttcagggtttcttggcctgtttctccatctgtgaagaggccaggtctgtctggagaaacttcagagagaggctgtgagtgctcgagaagggagcctgagtgtgcattgcagctgcctggcaggcatggcaagttgcaaactaacctttcaacctgctgtctctccaaccccgtctccagctgcccactctgcagcccaggctcaggaccggccaactgccaccgtgtcacccctgcgcacccagaactctccatcccgcctgcctgccaccagcctcaggccccactcggtggtgtccccgcagcacagccaccagcccccggtgcagatgtgcccacggccggccatccccctcacatcagcagcatcagccatcacacctcccaacgtcagtgccgcaaacctcaacggggaggctggaggggggcccatcggtgttctgtccacatccagccccaccaacacgggatgcaaactagacgagaagaaaagtgaaaaggtaagaggcccatcctggacgagccctgggctcgaggccagctgcttactgtaactttttggcactagatggcagtggcatttgtgcaattgaagctagaatgtgggctccaagtgcctgcccctagatgaaccaggcgtgtgacagagagggagccaaaccaccagagcagctggttggagaggaatcaggcaggccttgggtgctggcagggccatgcaagtccagctacatttctcatgcaaatcagaaaaaggtgtcccctcttgaaaatgccttagttccatctgttgtaaaatcattgtaatatactcattttgttagaacaggatatttattgccatgtgctgggatattgtaataataaatatacaaatctacgtgtgcagtgtgaacagcacccactcccttcaatatgtcatccttgtgcagtccacaacctgttcaaccatatgggacaggcctgtttcctgaggagcaatgagaaggaacaggagaatgctgacctgatggctggtgtgttttttagctattcttttagccatgaagtgctgatttcataaaagaaaatctgggccaggcgtggtggctcaagcctgtaatctcagcactttgggaggctgaggcgggcggatcacctgaggtcaggagtttgaaaccagcctggccaacatggcaaaaccccatctctactaaaaatacaaaaattagccaggcatggtggcgtgcgcctgtaatcccagctacctaggaggctgaggcaggagaatcactggaaaccggggggcagagcctgcagtgagccaagattgtgccactgcactccagcctgggcaacagagcaagactgcatctcaaaaaaaaaaaaagaaaaagaaagaaaatctgagtccaagaaacttgttccggttgccaccctgctagacgttagattaaccaggatgagaatccagacttctaaatcagtgctgtccagcagaaacataatgcaaacctcaaatctaattttaaattttctagtagccacatttttaaaaagtaaaattaattttaaagtaaatttaaaaggtgaaattcattttaacagcttattccattaaacccaatatccagaatattattgtttcaacatgtaacctatgttttaaaattgttgatgagatattttagtattttttttttacgtgaagtttttggaagcccatgtgaaatccaataagcaattctccagggctcagggcccatgcactgcctgaggctgtatccctagggcgttgggctgggtgctgggcaaggagccactctgtgtattggccttgctgcctgaacggtttagggattgttctctcttggcttgactgattctgcagatcttttgacatctttccatataaaattagtctttggatcaccctggacactagatggtgtgttccaggcaaggacagcctctctctctttctcgaggacattgccaaacccagcgctgactcggcgggctctctgcccatcaccctggaggcaggccctgctcccctgtcctcaacatgagccgggaacgctgcagacatgggccacaccaggttccgcagggcctcagcacctcctgtgttgttcagtccagagcaatggttgttcccgtgctgactggtgtggcagagccaatgcagctagcaaagctcaggtctgctccagcctaacagggcgcctggcatgaagggcaacagctgctctgtgttttgtgtgtctgtttgaagatcagttcagtcttgaatctgttcccttctaccctgcagcccttgttatgagatgtggctgggtctcatcaggagggagaggtgggattcacagtcctaccctctcacttaagcattcttccttcttctgagctgctcagaaacaaccaggggcagacttggaaagtgggggctgtaatagttccttaagcatttctagttctttgcccaagaattccctctctctagtttgtgaagcaaatgggactggcttcaataataccattgctgagtgggtttctatgacattacgtcctgtacgaatctacacggaggatgatgctgttccccatcacccacctaagtgtgaagctaatgaacaccagctgagtctgttcctagcctgcctgttagacactttgtaaatatttcgctttctcttaaggtttatgccctctaacagttgtgctatatcagcaaagaacagttgagtccagaagacaccccaacatccctcttgatgaaaggcgacatgcagggacgccctgccatgcaagctgcacatacagtggctcagcctcctcctcccctgatagctcccgagcctctgtgggcagcagaagtgcgtaggccacgcttggggctggacacatgctgtgggagcagtccacgctgcactccaggcaggaggggaagtggtttttgtgaggccctctgagcttatgtccagaggttcagcaaaccccagcagagaagcacattgccctcccacacattgtgtgtgcttttcattcccacctctcataaacaacaaagacaagcactggtctacaaaaccacctgtgaacattttgcccatctgtgttcccacttgaatttctcctaatttgcagcagggcccaaggcatttacagctgccatttgcagcagaagagcagaaatgatggtcattttagtccactgctcagaagcaagtgagccagtgtgacctgcaccagcagactgtgctgggctagggggctgcagccagcacactccctgcaggccgcttcctgagccccacccctccatgactacactaaacaggcttcctaactttgggcaacttgatcatagatgtacacatgtctaattatggcaaaggttttttaaagcatttggcagtattctccagtctgtttctgttaaattttctttgggaaaagacagtgagctcctcactcccacatccactgatgcatatacctcagtgcagcgcagtttcctagcgctagtgctgctaaattccacccaggcccttccatgcatgtaccagagagaaggcagggtggatacagctcctgggcgccgtagagtagggagtaattttctcctaggagcgtgggagatttacgcgccatatccctgtgtgtggagaaggaagaagccccaaaaccagctctgtgttgtgtggtgtcagtggctatggtcaaggtcccaggaggctggttcccgggaggcttgtgccaggaggcttgtccccaggaggctggtgctggcaggctggtcccaggaggctggtccctgggaggctggtgctgggaggctggttctgggaggctggtgccaggaggctggtccctgggaggctggtcccgggaggctggtgccaggaggctggtcccaggaggctggtcccgggaggctggtgccaggaggctggtcccgggaggctggtgccgggaggctggtccctgggaggctggtccctgggaggctattcccgggaggctggtccccgggaaactggtccccgggaggctggtgctctgctgctatatccagggggattgggcctttgagctctgttccctgcgtggcccgatgtggtgtgcaggcctctggggataatacaagtgcagacagagtggcagttctttctccagacccattcctgaaccagagctcctctctgggcccaggcatctgccagcctatgcaggaacctctccagcctactctcccaggtctcttcctgcccacctgcctgatcatattgctccctgcaggggctgccctgtggccaggcccccaacacccacaagttacacagtagaactcaaatctggttttaaaaggtggtcttcaggatttaagttatccttttgcacttaaaaatgaattttgtgcttgaaacaaccatggaacactgcctattgtgtccatccgtgacagttttctggttttgaaactgtgtgagcacatcagcaccaggtgatacgaaccctcagggtacctaagtccaggggagagtcacccagaagagaagggtgcaatgggctgcgtgcagttggcatccctaaccacccgaccggccatcactcactctcttacttgtgccccaatccctgactcatctgtgtattgcaaagagcatgaggatgtacctggcagagcgcaggcacacggttcataatgatggaaaggtcaaccctggcctggaggagccagagtatagtacaggtcactgtacaggtaaacaggcgattgattgcaggagagggtgggtgattgacctgcgtgtgggaacagagggtcaccgacaaaggcgcctggtcagcccaggtcaggggagacttcccggggcacagatgggaggatccttggctgagggtcagcctgagcagaggccaggggacatggcccgaagatgagggccagggacgggagaggtagcaggcagccctgggagggcctcgttgccaactgctcagcactgcaaaatctgcagatgctgggcaggagggtgccatcctgtaacttaactacttaaatatcctgtaacttaaatactatcgtataataatcatatcatataaaagtcagtgcaacttacattacatggtgagataagagagagaagaaaacaaaggtactgcttaatatacacattcacacagacatattcataataaaataggaggaaatacttacaacaattacaatcctcatttctgtagctgttcacatggtcgtggctggtatttataattactttgtctactatccaatctgtattccccttcccttcagaaagcgcctcagctgggcatggacccttacctggtggggtgacccgaaccttcactcctgaagggtctgggccatttttagtcctgtctggattgggtggttatagttttccattgacctcaggaaggcttgagcacaggccatgagtggtgctccttgcctcctcggggttctgagcctcttgctgtccctgtgcagttgaccaagtccacacggtgagagcgctcccgccggctgcctgacttctgtggagccctctccttggtgctgaggttccccaaggctctggcctggccatgagttccacagcagcattcttcaaatgatcaatccagtggattgggacccacatttttatttagattggatgggataaacagaatgaaacagggtaggatagatcttcatggtgagcatacagtagggacggtacactggggagcttctgtgttgctgtgtgcgagtcctgacataaaacttaattcaaaaacatctcgaagccttaggtcgacaaccccagcccatagaaggcacctggtgatgattgtagactaaagagaattggaaaaactgctgccagtaagttttcactctcacgacttatgggaaattctttatgggccagaaaaaaaaaaagttaactctctctttatgggtgtggtagttttagtttcagtgagtaatagaatattgaaacttgaaagagcctctaaagatgttttatattaaactctccattttccatgatgttcctgaggctcagagaccttcagagacttgcctggggccacacagcatcggcagtggagctggcatgggaatgctggcctcctgcctcctgtgttgggtccaagtgctgactgtggtggcctcctagtccctgggaggtcatggcccgtccaggagtcccacagtgagacatccagggtagcggctggcaggagaccatgaggctggccttggggggagaaagggccctaggtgtctgccttctgggtccacattggacccagccacagccagaacccatgcaacaatgaatcacttaccagtccatgtggatgaccgacataatcaagactgcaaacccaatttggtctgaaaggaacagaggacctgacagaatgacccataatgacagcagcaaggcctggtctggggcgtggagtctgtgggacacatgtgtgcacccacccattaaatatatgtatatctcatatatgtgtgttactatggcatatacactcatgatattatataggagtgtgattatatttttcatgaaaccccaggaacatccaatctgaagaaatcttgaggatgaagctcttttgagtggccaggcagctctctctaaagtgaagaatcgctggcttataaatgtatttcctctcgagtggaggcaccctgcaataggtagacccttactcgtccatcccagttctgtcgacaggcagccggggaagccagctgctgccagcgctcatcccagcttctccaggtttaccagtgccattcacttccgaagtgacagctacactctgctggcacaggctggctgcatgctcccaccaaccagggtggggaggggcctgctgtcacctgcacacactggcatgagaggtagaaggggctggatctgacctcacccagaactgattcacccacgtgggaaccatcatgcaggtcttaggggagacctgccctgcagcctgctcacggagccccttggcccatgctctgtcatcaggtgcagccacagtctgatgcatcgctgggctcccaggcccactgggggcttgggaacctcaggtctgccgcacagcaaagtcactgaagagtctcatggtcagccatgggccatggaaaccacctctgccctggccacttgtgcctggcagctctgctggttagtggcactggcgttggctgggcagaaggggtcgcagagtcagccccgtgtggctgggagcaccggcgactccaggtcctcttcctgttcccctattgtcaggctgccttccgagggataaggggagccagcatgtgcggctgaaaatgaacccatcctgaaagcgtgaatcccagctgccaaaaaacattttgaagttttccagacagccttttttggaaggcataaactgctggagcatcgcttcactggtgacaggagtggcaacctttctctaagttaggaatgtcccgtcagagcacaggccctcagtggggcagggcagtggcccagcctggtctgagcagaggtcagtggtggcctggaggcttctcttgttatctgcgccctcccaggacagcaagtgaagctggctgtccccagttctcctgtagaaactccgtggcctctgcattgggatgagacttctggatctcagcgtggttgtgagtgctggtgaccctttcagggtacaaatgtggacatgaagtccagagaggcaaggtgacctgcccaaggccacacaacgagtagggcactgggaatgaaaccaggctccatggtacccacaagtgcccactccccattctctgctactgctagtcagcttctcttctggggagaatagcctagggctcatgccgctgagccttcagaaagtggcagggacgagggaaggagcacagtcatctcaacagcgagtgaagcttgaatttggaggaggaagacacagtggattaatcagcatggagggtggacctggggtcggctgcctagtgtgaatcaatctcctgtttaccaattatgtgacttcgagcaagcttctccaccttccatgcctcagtttccacatctgtgaaatggggacgatagcacctaccaccctgagttgttgggagtagtaaatttagttagtttgacgaatgcataacatagtatttagaacaaaagtattagaaattattattaagaatttgatagttaattgaagtctggatcctagaattaaatgatccatacagatgtaaaacttatatccccgaggcttctctaaaagatcaaaggaggggttaattttgttatatgaacaatgaagggaactcaagtaaactattattcagaagtagggtttcaactgcaaagcattaaaccaaaatgcatttttaaaatagtaatacactttagaaaatgaaaaggatttgtaagtcatgtgtaatagttgtgagggttctgccaccctccccaaagggcactgactaataacgagtaactaatcaggattactgtgaaatcctacactctagtgccacacgagctgaacaagcaagcgatgcgtgtgacagtgtggctggggcgagcgatgcacacactgcatggccgggagccccggcacaactcaattcccacatcaagtctagattctgttctgcaaaattctactgctgtgactgccttctttttcaactgatatattctcacagtgctttcaaagacatgggatttttttccagccgtccatgcccagaaaaactcagtgatggcattagttcagaagaaaaacaagcgcacaccccataaactacatcagaaggtaatgcccacacatcagacccagccgtctgtccctcccagaaggcaacaaagtcagcatggcggggcatctctgaacattccacagcacttgccagcactctccattttggtcccataactgagggaaatgtcgagaaagaacagagagtgctgggttcggcattctatttgttgtggttttattttgttttttcaggcactcaggccatgtggtgcaggagccggggagggcactctgtaacctcaagggaataagacggcttcataccatcatctccctctaggggaagtcactcctgggacagtttggtttttattcacctgataagctatgtgcttgcttattaaattccttccaggccgcatcttactacattataggacacatttgtatatagcatgagaatgaaactcattaatcttttcagaggattcacactctgtctggatctcaaatagaaccaataggtcaacttcatgaaaatgttattgctataggatttctttgtaagaccagcagaaatggctagatttatggcttcatcacctgccttctaactcttatttattctctctttcactttaaggtcaccttacaactcccctagacttcagtttatttagtgtgaaaatgggaataatgtctttttgtactcatgggaatactataaaaattaattattggtttgtatcagtcagggatctccagagaaacagaaccagcaggagacagagagagagagagagagagagagagagaatttatttattttaaggaattatgtgactgtggaggctggcaagcctgaattctgtggggcagcccagcaggctggaccctcagtcaggagttgctgtgcagtcttgaggcagaaaatcattgtccacaggatgcctgtgattgctcttaaggccttcagctgattgggcgaggcccacccacattatcaaggtatgtactttcagtaatctcttttacttaaggtaaactggctgtagatattaacacatttgccaaatgccttcatagcaacatctagattagtgtttgctcaaacaactgggtacctgcctagccacactgacataaaactcaccatcaccgtccatcctttgtcagcttgacatctccctaaactatacttagtttccacataaagacaaaagcaaagtcatacttctgcctaatatgatacaacaagcctgactacaccaagagtgcatgcgcccttcccagaagaggattcagagtctttgagtggtgcttcgtcttcttcttgatatcttgtaacttaaatactatcatataataatcatatcatataaagtcagtgcaacttatattacatggtgagataagagagagaagaaaacaaaggtactgcttaatatacacattcacacagacatattcttaacaaaataggaggaaatacttacaacagttacaatcctcatttctgtagctgttcacatggtcatggctggtatttataattactttgtctactatccaatctgtattccccttcccttcagaaagcgcctcatctgggcatggacccttacctggtggggtgatccaaaccttcattcctgaagggactgggccatttttagtcctgtctggattgggtggttatagttttccattgacctcagtcacggggcattgtgattgagagcgtgctaggagacaccccaagggatctcctgtatcccagacatgctcttgcccatgtccactatggagtgcagtccagtttcccacggtggtcaggatcagtcacccgagccagcacagtagttcccgttcctgcctttgattctaagccacaaggatcccaaagcggctgagtggcagtcttgaattccagctcaatggaatcattgtcatgtttcctggtggcaacattcctccccctggaaccaagacctctagactagtagaacataatgttgtgagaacaagaagcagacattttgctagtgggttactaggggtcataataagtggtgcttctcccatttctgccccatgattcctgggcccatgagtcctggctgtaggagaaatagcaccatatatttgatgctgattcagagcatacccagccttctggagaatattgtcccagccctgcaagggactgtcacccagctggtgctgtaactgagtcttcaaaaggtcattctacattctgtcaagccagctgccagcataatggggaacatggtagagccagtgagttccatgcacacgagcccattgctgcacttcatttgctatggagtgagctcctcagtcagaagcagtgctgtgtggaataccgtgatggtggttaaggcattctgaagtccatggatattcactttggcagaagcattgtgtgtagggaagacaaatccatatctagagtgaatagtatccattccaggaaggacaaaacaccattgccccttccttgatggaggtggtccaaggtagtcaccttgcccccaggtggatgctgaccatctcagggagtggtgacatgctggggactcactgttgttctctgctgctggtggattggacacagtggtagtcgtagccaggttggccatggtgagtggaaatccatgatgctgagcccatgcatcacctccatccacagtggccactctgttcatgggtccactgggcaatgacaggaatggctgaggaaagaggctcagtcattgactgtgctccacagaatcccatctgtggaattactaaagtcctcctctgctgaggtcaccctttggtgagcatttaaatggcacacaaatttcaccacatgttttcccattgaaagaggtcttttcacatgtgcttttccaatttccttgtcaccaattttccaattatgtttcttgcaagtccctgaccaaccagccaaatcatcggccacagcctatgaatcattaaacaatcacacttctagccacttctccttccaagcaaagtgcacaaccaggtgcattcctcaaagttctgcccactgagaggctttcccttcactgctgtccctcagggatgtcccagagaggggctgcagtgctgcagctgcccactttcaggtggtgcctgcatatggtgcagaaccatctgtgaaccaggctcaagtcttatcttcctgtgtgatcctatggaactgcccaggaggccacaggtgcaggctgggagagagaaggcagcatagcaggagtggtgaccataggcattttaggccacttcctcatgtaacttactggtgccttcgggacctgctctaacccgatcatgtgtccacccttccatttggtcatggaatgctgctgtgcacgcccagctttatgcttggtgggtcagataacaccagttcacagtgggcagctctagttgcatggtaattggtggctcatggtcaagcatttagtctctaccaaggcccagtggcagaccaagaactatctctcagaaagagagcagttgtccttggaagacagcagaggcttgctccaaaatcctaaagacctgcgcggtgatccacctgccaaaggccccacgtagcatccctgtctgtcctaaagacctgcgcggtgatccacctgccagaggccccacgtagcatccctgtctgtcctaaagacctgcgcggtgatccacctgccagaggccccacgtagcatccctgtctgtcctaaagacctgcgcggtgatccacctgccagaggccccacgtagcatccctgtctgtcctaaagacctgcgcggtgatccacctgccagaggccccacgtagcatccctgtctgtcctaaagacctgcgcggtgatccacctgccagaggccccacgtagcatccctgtctgccacaatagtgcctcaggcaccactggatctcctgggtcatgtggcccaagtggtagagcatctttcacagcagcctggacctgttgcagagcctttttttgttctaggtcctactcaaaactatcaattttgggggtcacttaataaataggccaaattaatacacccatctgaggaggatgttgtctctaaaaattcaaagagccccactcacctttttaactctggctataggaggggctagacgtaaccactttttctccaccttacgagggatgtctcagtgtgcccccacaccaccaaacccctagaaatttcactgaggtagaaggcctttgaattttaattcaatttatttcccatcctctgacatgcaggtgtcttaccaacaaatctagagtagttgctgcttcttgctcactaggtccagtcagcacaaggccatcaatgtcatgggccatctcgtatgacatcttgaggaaggcaaaggtgatcaccatccctgcaaactattttgtgacacagagttggagaattgatctacccctgagtttcattgctggccttgcctgctgaaagcaaactgcttcagtctttactaacaaaaaaagcatttgccgaattaatcactgcatatcagataccaagaggtgtggtggattaatttgcttaaacaacgaaaccatactggtatggcatctgcagttggagtcaccacctggttaagcttatgataatcctctgtcattctccatgatccatctctcttctgcaccggccaaacaggagagttgaatagggatgtggtgagaatcaccacccctgtatccttcaagtctttgatggtggcactaatctctgcagtacctctaggaatgcatattgcttttattttaccattttctgaaatagaggcaggttagtggcttccactggcctttcttgcataacagccctctctccacaggtcaggaaaccaatgtgaggattctgcctgctgctgagtacgtctaggctaatgatgcatttcagaactggagaaaacccacaggatgggttcagggccatacttgaactgttgtgagaaggacatgagataaaactccactgatcacctgtgctccataagcccgtccctgactggcagaccatagtgacatttggctctcgtcaacttagggtcagttcagatccagtgtccagctgtccctgaaaagtctgattattttctttcccctaatgcgcagtcaccctgttaaggtagatccctttggggaagcctgggagaaagattaacagtgtaagattttggtatggccctggggtctttcctcaagaagacctaacctgtaaattcaagggattctgagtctgtaaagtagctcaagcctgggaattgattgaagggttgtgactctgttttgtgattcaagttatacttctgttcactagacctagaactcttctgtttacacagctcaagtaagaatttagtagacagcccatctatttctcttccaggaatataatggactgccagttgccagttgattactgccttgactgtgctgtctgttttggtaacttgtctcacggtattaccacctggtcggccttgtctttggtaattatgtgccaccatgtgggccctgccccccttgctctgggacccagtcacttccaggtttcccagttccatggccatagttcccactgtaaggtccggcctgtggagaagtgtgactccagagcttttcaagggtgcgaggactcccctcacacatctgtttctcatagtcgtggtgaaaggcgtgtcctctggaccctcctggggtgggaggaaatattagttacttccaatttctgattattgtgcaacttggtaacaaacagggactctggaagcaatggggaagaagccatcagaccctgaggctcacaaaagaggagatgttcatgtttgtttccgctgcagtcaagctacccaaagtttttaacaccttggagagacctggctgcaaatgtttgttttaggaacatgctaagaccatggagaatgatgcctctgtgacatggagagatgcaagggaattgtccctcagtggaggcccctttctccctgtcacaactgattccctcagctgggctttgaggactctgccagaggtggtatagacagggtaggggtgaacatttagagtcttctcttagaaagaggcacccgtacaaagtgtgcctggcaagaggtcaccaggagaggaaggatagaccctcgctcgggagggtccccaattcacagaacatagctctagaaaggagaacagatggcatctgtgctggtagacctgccagcccccacactgccagcaggccgggctgcagcatttttacaggggatcattcagtttcttctaaaatacttccagggacaagagctcaccacttaatgagggggcttgttttatggctggactgacctattaaaagattcatcctcttgtcgggcaaaatctacagagtctacacacacagatacacatccacacacaaatatacacacattcatacatatacatacacatgtacaacatgaactcacgtacaatgtgaacacatacaaataacattcacatgcaataagcatatttatgtatatacatctacatgaatacataacaaaaatacacatacaaacatgactacatgtacacacattcgcgtacatataaaatacatgtgcacacatgtaaacatctgtacacatatacagatgcatacacaaatacatacatgcatacatagccttgcatacatacacatcctgcagagttgatccacttctgccaattctgctccctcacaatcgatttcctcttctaaaaatagcccttctgatattggaagtcatccttccaagactttttttaaagagactttattttttagaacaaatttaggttcagagaaaaactgagcagaaaatgcagaaagtcctcatatactccctgctcccacacatgcacaatctcttctactatcaatggcctacaccaaagtggtacatgtgtcaggactgatgaacctaccttgacacatcattacccaatgtccatagtttacgttaggatttactcttggtgttgtccaaaatctatggattttgacaaatgtataatgacatgtgtccagcattatagtatcatacaggatagtttgactgccctaaaaatcctctgtgctctgcctgttgatcactctttcacatctaactcctggcaaccactgacctttttactgccttcatagatttgccttttctagattgttatacaattggaatcatacacaatgttgtagcctttttgcattggcttattttatttagtgatgtgcatttacgtttcctccatgtcttctcatagattagtagctcagttctttttagcactgaataatattccattgtccagatgtaccacagtttatttatccatttacttaccaaaggacatcttagttgcttctcagttttggcagttatgaatacagccgctataaacatcttgtgtgggtttttatatggacataaattcggataaataccaagaaaggagattttaggagtatgtaagagtatgtgctgaggtcggtaaaagtacatttagttttgtaagaaactgccaactctcttccaaagtggctgcaccattttgctttcctaccagcaatgaatgagagttctcattgcttcatatcctcaccagcattcagtgttgtcactgttttggattttgccatcctaatagttatgtagtggtctctcattgttattatactttgcagttccctaatgacatctgtattaggccattcttgcactgctataaagaaatacctgagactgggtagtttataaagaaaagaggtttaattggttatggttctgcaggctctacaggaagcatagcagcttttacttctggggagacctcaggaagcttccaatcatggcggaagacaaagagggaacaaagagtctcacatggcaggagcaggagcaagaggggagggaggaggtgctatacacctttaaacaatcaggtctcatgagaactcactcactgtcacagggagggcaccaaggagacggtgttaaaccattcgtgagaaatctgcttccacgaccattcaccaaggatccgtccccacgatccagtcacctcccaccagaccccacctctaacaccggggattacaattcagcatgagctatggtggggacacaggttcaaaccatatcaacatataatgctgagcatcttttcatatgcttatctgctacctgtacatctttttttttttttttttttttttttgagatggagtctcgctccgtcgcccaggctggagtgcagcagtgctatctcggctcactgctgcaacctctgcctcccaggttcaagcgattctcctgcctcagcctcccgagtagctgggactacaggcgcgtgccaccacacccagctaatttttgtatttttagtagagacggggtttcactgtgttagccaggatggtcttgatctcctgacctcgtgacctgcccgcctcggcctcccaaagtgctgggattataggcgtgagtcctgcgcccagcctgtacatcttttttaatgagatgtctgtttagatctttgctgagtttttaattgggttgtttgttttcttataaagttttaagagttctttgtacattttagatataccacagtggtcttttgcaaatattgtctctcagtctgtgacttgttttctcattctcttgacagtatctgtttcagagcacaagttgttaattttcatggagcccaatttattaactatttcatgattgtgtctttggtgttttatctaaaaaggcaccactaagcctaaggtcctctagatttttccatatgttatcttctaggagtttcatagttttgcattttacatttgggtccacaattcattctgagtgtgtgcatttgtgtgtctatatctgtgtgcatgtctatacttgtgcatgtgtgtatctatatgtgtgtatgtctatatgtgtgtatgtgtatgtatatgtgtgcatgtctatacatgtgcatgtgtgtatatgtttgtgtgtatatgtgtgcatgtgtttgtgtatgtgtgtctatatgtgtatgtatgcatgtatgtgtgtgtctatatatctgtgtgcatgtgtgtgtatgtcttcatactctgtgaaagagagaaagaggctgcatatttaaagggttaggctgagaaccctcctgctctgctggtggaaatgtaaaatggcacaactacttgggaaaatggttcagcaattttttaagaagttaaacatgccacctgtcactcagccattccactcctaggagaagcagacacacaggcctacacaaaggctcctgcatgagggatccgtagcagctttatttgtgacagcctcagactggaaatggcccagatgccaatcagctgatgaatgcatgcacagacagtggctcaaccctgcaaaggggcaccacccagcaagaaaaagaaaccagctgctgatacacacagcaatggaagggaagcgcaaaatcggccaagagccagacagaaagcagaatagccactggagggtcccgtgtctataaaactttggaaaatgcacacccatgtttagtgacagaaagcagctcgggggtttcctggggactggaagaagccctggaaggacagcaggactggggggcttgggcccaccgtgagggcagcggcaatgcacatcgcccagatggtggggctgctgcagggggatctgctaagtcaaaacttgtcaaatagatatttttaaaagttaagacagcactttatttttaaaaagaacatcatgtatttttgtgagtatatagattttagagccagaagagaggacgagcatgatttccatatctatttgaggatgagcgtttgaagcagctcctctctgatttaatcccactgggcaccttttgcctgatctgaccgttctgcagtcccctggcagcagtcaggacaggctgcacacgcagaggaacagagccaggctgagcaccctccgccgtcattcacatccctcacagacctcagatgcctgtagccagctgcaccaacaccccagggcgcagtcctgtgaacatgctccacctccatgcgggctgctgggtcagaggcagagagaccctggaggacctcctcagagcggaaaacatttcagcccagaagtgacacacatcacatttgcccacaaagattcccacaactcactaatcaaaactagctagatacggtcatgtgtcacttaaagggaatacgttctgaaaaacgcgtcgtttggtgattttgtcttgtgaacatcacagagtggactcacacaaacctagatggcacagcctgtgacacacctaggctgtgtggtgtagtctctggctcctaggctaaaacctgcacagcatgtgactgtgttgaacaccataggcaactgtaacacagcggcaagtaccgtgtgtctaaatatagctaaacataggaaggggaatgcgttgcactgtgatgttatgacagctgcgacatcagtaggcaacatgaatttttcagtttcattatcatcttataagacccccattgtgatctgtcattgaccaaaacgtccttatgtaacatatcatgctgcttggtcccactggatctcagagagggcaggaagcaaaatgtttccatgcgcctggcaagaagcgagcacaaacgatgaccagtcaggataagaaggaagttaggcccggtgtggtagctcacgcctgtaatcccagcactttgggaggccgaggcaggtggatcatttgaggtcaggagtttgagaccagcctggccaacatggtgaaaccctgtctctattaaaaataaaaaaatgagccaggcatggtggcgggcacctgtaatcccagctactcaggaggctgaggcaggttaatcgcttgagcctgggaggtggagtttgcagtgagccaagatcgcggcagtgcactccagcctgggcaacaaagcaagactctgtctcagaaaaaaaaaaaaaaaaaaaaagttaaattcagagctgcttctcatggtgacgttttcaaccctctacggctttgatactggaactgccttcccagttagtggtggtctcccgggggctactagatgcatgtcaagctcaaggtcttctaaagggctccagccaccagtcttggctcaggaggctgtgggagcagggccaggcatgtaagctgagaacacaggctgtgcagggcctgaggtgtggctttgcaccttgtggcccatgccatgcctttcttctccaccccaagaatgcgggccccctgcagcattccacagcccgtgcttacacagcgtatttcttctgtgcattgtgcgctatcccagaatattcctggatgagtgagaatttatcaggagggaagggcctggatctaacagccctaaagacaccacctcactgtgtcctccactctgtatcctggggtgtgtggcatgcggctgggcccctgtggccctttactagcccccgtgctttgctttggggccagaactgcctgcctggtctgttggttttccatgcatgcatccgctgctctgtcgaggaagggtttgacagtaatgcctgttgtgcaggggtcacactatgtgtgcagtgggatggtcttctgtggcctaatttcatcaaagcacaaaacttaggctgcctagaaaataacagttaatgtgtcctctgtgtgtgacttctcctaggtgggctggcaatgggagctgggccccagtggctcagagtgactgagcactggtcttgtgtacttctgattaaggacaaatccacaagctccagaaacccaacaagcaaatagtaataagtctggcagaacgctgaaaagcttaaccattatgtttttgctgaacaaaagaacccccagatctcatgaagaaaagccagaaaaccgtgcttttcctcagaaggtagatccgaatttttccagccgttggttatgtgtgcagcttggggccaggcgtttgtccactgcaaccacaacctcagacattcttctgtgggggtctgagcctggacagcagtgttctcagagcactttccaggacatgcgagctataagatgaacccatgagcagatacgcttgatcctgcaagctggagttacttagtgttgatcatttcactcttcgtgcgtcctgtctgagggttagctgagcccgttctggtggtgggcaaccacagagctgtcttctggctaatgaagacaaagccaccttctcaactacaaggattccttgtcccttctggggtggctggggtggccctgtctcctcaccaaaggctcctgggacctcactacgtaaagagatgagattactttggaatgacttatttcctcatcaataagtgatgggagttagaaggatgacccacagcacccagcagctctagccacatgtgaaatccatgcttgcatttcgggtagactcctgctccatctggaaaagatcatcttttccagagttttgctggatctcaacaagtccctggaagcgccttgtcaatctttggttctcagaatttgctcttccttattgcacgtctggggagacaccacccacttgagtgtagttgccctctggtcattcacttatttttcatctattgacttaacaaaatatttgtggagcacccactttgggacaagccctggctcagtactctacgtgcagagctgaacaaggcagtctggaggaggacaggcagttacaccaagctccctggactggctctgacagtgccacgcatggggtgcctagaaactgctgtggccggggctggtggaggatgggtcatcacagaaatagcagagccagaggtgcagatgtgcaggaagtagaggcctcggctcagccacccctgttccacaggccacagcttagagagaccctttgcagggaagtcagctcacagcaaacaaagggtgctgacatttcattccttcttcctcatgataagaaatctcttctgttgcctgaggcagagtcagtgtattagtcaattttcacactgctgtaaagaaataccagagactaggctgggtgcggtggctcacgcctgtaatcccagcactttgagaggccgaggagggcagatcacttgaggtcaggagttcgagaccagcccagccaacatggtgaaaccccatctccactaaaaacacaaaaattagttgggtgtgttggcaggtgcctctaatcccagctacttgggaggctgagaatcacttgaacccagggggcagagtttgcaatgagccgagatcgtgccattgcactccagcctgggcgacagactctgtctcaaaaaaaaaaaaaaaaaaaaaaaaagaaattaatacctgagactgagtaatgtataaaggaaagaggtttgattgactctcagtttcagctgggggtgccacaggaaacttacaatcatggcggaaggcaaaggggaagcaagcaccttcttcacaaggcggcaggagagagaagagaaagtgaagggggaagaatcctcataaaaccattggatctcatgagaactcactcactatcacaagaacagcatgggagaaactgcccccgtgatctagtcccctccctccaggtccctctttgacacatggggattacaattctagatgagatttgagtggggacacagagccaaaccatatcagtcagtggcaaaattcatcattggaacagctcatgtaggcccagacactgttgtattccatgggtgaggaggttgctgtccaagccacctgctccaggacacatgctggggcggggtctaagtctctttcttttccactcacccccttgctgtctcagcctcacatacctaataagacggtcccaagagcttagccataggagatagactaatgcacagtcctggatagcttgtcctgcctttttgcatggggcacgtcttgttaaactttttccacactctatttgctgagactatgcagacacagggagagcagatgcctggcagttctctagaaggcaggggctgtgtgaacagcagttcatgtaacttggtctgaagcaggccattttcctccatggttatattgccaattcagggagaagcagagtcctgggccccctgcactgtgtggccctgtagcacagtgtgcacctggattctgacatctcagcttctttcaaattcccatccttttctaattattaattagattgttaattattattaattagttaatatgattaacaaccacctgtgacctcatggtagcagctccttatagaaatgtaggagcagtccccagttaaaaattagatagggataaaagcccaaatcagggcacttattcagggaggtgccacctggccagggtctgggctgctccaggaagacggtggcaggagaggacccggccaggggcctcccgggccctcctcacctgcactctcggtggtctcgggccggtgtgcatgcagggtgtcctggaagcaatcttccttaagaagcacagaaagaggaaatccaaaccatcctgcagagcttgcggggcttcccgacggggcttcccgtcagggcttggcaagctggcagccatcaggaaggacttgtggaaagaagagctttgatttacggttgctgcctcagaaaccccgatccaattgatgaaccgacctgcggctgccttctggttggatgaagtgatttccatccatctgtttcatttaaaaacaaaattcaggaagtgagcttgccatacctgactaaataatagtgtgtttaatttttcctgtttcattccagacatccttcagaaggaggccagattttacagagatttcatctgaatgcattccatttgatctaataatttatggctgtgttgtatttgtcctacagaaagccagccagacgcccgttggaaatccaacacacagcaaagttatcctaatggacagggtcgtgacacactcagacatatcccagggcagacagccctgctccagcctcttatttctgtctgtcctacctttggcctaatctcctttgaagcaattttaaatgaatgaatgtggtgctataaattctacccgactcgtggggcctttcctaccttagtgaaaagataatgtgttggctgagatggcaaggagacagggtcacatggtgttgcagcctttcagatgcgagtcccaagaatctaaagagaactgacagcctggcatttaatcgcccctcatttaacagcattaactcaagttaactcttgcaaagctctgtgatggattttcccagggaagcggcttcctgcctagacatacgagcgcctcacacaggcctgggctggccccattcgacgcctgggcaccactgggagcctggagctggggttgggccctgcagagccagagcctcttggccatgggcagctgtgcctgggcttgtggctggttaccaagcacaagttgacatcgtgttcagaatagggcgtgctctgaggcccccatcagcatttggcaccaaattgggacaaatacaatgaggtctgagcccctattttatttggggaggctgtgggggatgtaaaatagcagatataggtgataaagaaggcctgagcaacagagccatgccagggttagagcgacagagaggagagagaaataaaccctctgtaactgctcatctgggattcaaagaagatggtttctgaatgggacctaaagcacaaacaaggttcaagggggagggatgagggagcatatgtgtcctaggtggagggaggaagcagcgtgccatgtcctgctgccgtgcccagctcactcagccacccacccaccccacccactcctgcctgcctcaggctacctcctcccctgtaacactgagcctgagaggcctctgagccccccgtgcacagccagcaccttagccgcaggctgtctcttttttggggtgtccctgaaccgctctccttgtgcccctgaaccgctctccttgtgccccttgatcatcagcagtgctgtcattacccctagggtaatgctgccctcccacaggggcagaaagtctttatagactctgtcctggaaggtgctggaggccaatgaggttatgacaggggctttgatgctggagactttctgtgcctctgtgtggcctcctcacctttggtttgggggttcgtggcttccatttgatgcacagtctgggccgggctgaggaaggtggcaggtgttcagaagacgcaggtggccagggaagcttggccgcacctgcgtaagagcacacacctgtgtgtgggcaggtgtaagccatgcagtggctctctagggaggtgggtgtgggcacatttgtctgcagcagtccttttagcagtgggagaaagagctgaagttttgagccggacagttagttatgtgtcaggctgtttgagaggagaaacccctgtgggtttctgtgagccatttgggctgtaagtgtgagctagctgcgtctaacaaagctctccccctaacagagaaggaggggctgtttccactgtggatgcagctcgctactgatgggaacctaggtggtccagagcaggccatgatccctggggacaggcggcagcagtgggaggccctcagttggcctgaggctgggattacagtccgaaccgcacggggcttatagccatgggcacagtgtccctgcttcagacttacccaggtttgggcagggggggagaacgcaggtgaaattccagaagcttcccgctggtctgccctggacagcatcgggccagccccttacttttctccaaagcatcgcagatacttcaccaccatcacaggaaacagtggggcagagccagatggatccagtgatccgaggccctgcacaccctgggacaggaagcacagcaggactgacagcaagtgcccagggccagtgccctgtgtgcgccaaagtctacactcactcatagtccagcaaccctccagagccagcagggaagggcagcacccctccctgaatcacagacattaaaatagcacctttcagtgttttttgtcttttgttttgtttgggttttttttgtttgtttgtttgtttgtttttttgagacggagtctcgctgtgtcaccaggctggagtgcagtggtgcgatctctgctcactgcaacctccacctcccaggttcgagcgatcctcctgcctcagcctcttgagtggctgggactacaggtgcgcaccaccacgcccagctaattttttgtatttttagtagagacttggtttcaccatgttggctaggatggtcttgatctcttgacctcgtgatccacccgcctcggcctcccaaagtgctaggattacaggcgtgagccaccacgcccggcttcagtattatcttaaatctccgagggctacaggactattgtgtctgccaaatggattcttcatttctccacctcctcatgctccaaagcaaacccacgcaaagtggctaccagtccccctgccttccaggagctgttcagaatttagtacctgcagcttcttgggtcttaaagcaaaagctgggagaggaatgggtcgagaggcagcctggggcgctgaagccacccacctacttctgcctcatacagttggctgtgggtggggacagggacatatgccacagaggctgacacctgccctgtagccagggcttctcaaccttggcactatcagagccagataatcctctgttttgaggactgtgctctgcattgtaggatgtcgagcagcatcccaatttctactttgtggatgccagtagcacgctgctgcaccccagctgtgacagctgaaaatatctccaaatgttgccaaatggctcctcgggggcagaatcaccctggttgaattcctggttcctctgaaacagtgactgagtgtcagcactctggggcctggctgcctctaccttgggctatgctgatattgattaccttaagcaactcatttctctttccacatcttcacgagcttcaccttcatcaacaaaagagccctaggccaaccaaaaacttcctgtggtgaaatttagcttgttggagctgactcttcttgctcagctgaaactgtgcctgctgatgagtaagtcctggagatcggctgtgcccagagttagcagtactgtacggtatgcttagaaacttgtaagagggcagatctcaggttaagtgttcttaccaaactaagaggaaattatttaaaatttgcttattagcacagcaaaggctggagaaggctctataagggataagctgttacctgagtcctccactcagccctgcccccaccaggcctgctagcacccacagcacaaagttctccagacacagtggggttgtgggcacagtaccccaagggggtcaagtgaagatcaaatgagatcatgtatgtgtcagtcctttgacaactgtgcctaaccccaaggggaggtactgggtagcccctgggtgaggtactgagtagcccctaggggaggtactgggtagccccaggggaggtagtagtactcaaatcccatcagactcttcagacagttcatacaaggaggtctagaacccaagatatttggaccttcaggtgaagcctggctctagcatgtcaaaggctaaaagatactggactttcctctaaagctctcgggctctccatgagcctcaaacacatggttatgaagtgattgtgttacaggaaaggggtcccaatccagatcccaagagagggttcttggatctcccgcaagaaagaattcagggtgagtctgtaaagtgaaagcaagtttgttaggaaagtaaaggaatacaagaatagctgttccatagacagcagccctgagggctgctggttgcccttttttatggttgtttcttgatgataagctaaacaaggggtggattattcacacctccccttattaaaccatatcgggtaacttcctgacattgctgtggcatttgtagattgtcatggcgctaatgggagtgtagcagtgaggacaaccagaggtcaccctcatcaccaccttggttttggtgggatttagctagcttctttactccaagctgttttatcagcagggtctttatgatctgtgccttgtgctgaccttctgtgacttagaatgccttaactgtctgggaatgcaccccagtaggtctcagcctcatgttacctagcccctactcaagatggagttgctgtggttcaaacgcctctgacaattggcctgaatgaccgttggcctaggagaactggaaatccttgaagcttactgcactgccccgggttgcacaccctcacgtggtgactgtcaggaactggcccagagtgggggaagtcactccccgttcctgcacaggcacagccttcacgcccaaagaccatgccgctccctgccctccatgaaaaaagtgacaggtatatgggcccaccacaatcattcattccccacagccactgtccttggaggctccttcattcttacctccccaacccaacctcaaagtcccgaaacgggcatagagttctcccagctgtgggctgagaggccccctcccgccagacacatgctgaggtgagaccaggagagcctctcccagcaggaagagggcagttaaagggactggggtcacagcgcctgttgtagtcccttgagttgctgtaacaaaatgccacagatgggtgtgtgtgtgtgtgtgtgtgtgtgtgtgttggtgaggggtgtcagcaacaggagtgatttcccacagttttgcgggctggaagtctgagatccagacaccacagattcggtgtctggtgaggactggcttcctggttcatagacggcgccttctcaccgtgtcctcacgtggtcaatagggcaagggagctctcacgacccgatcatctcccagagaccccacctcctaaggctatcacactgggagctggggttgacatgactttggggaacatgtgcattcaagtgcagcagccccacacccttggcatggacctgcaggaaagatcctgccctgcctttgctggagggttcccgcaagggcctcctcctcacctctccccactgctcatgaaatattactggaatgattagaaagctgagagagaccctggggaggaggtccctgagtgtcccatccaccacagtgaagaaggggccctgccaagggctttgagctctgcagccggagaggagctgcctgattggaggccgcctttggggcaggcgattctagtgcattctatgacctaacggccttgttaagtttcacacttcacgctggctcccagtgtatttttcattccttctctctctcagttcccataaagccgtctagctgtccctgtgatacattcaaacttgcactgtttggattccctaggctgtctgaaaatgtgtcctttgagtaaaatccttctccctcaattcccagttacgtctttaaatcaagatgggccctccagtctctaaacaccccatcagtgtgagatggcaccttgtttgcttttaagacctgcgatttggtttgaatgtattcagttatctagatgtcttcatgctttccatgaaaatgtactgaggttcagtccttggcatttttccttgcagaattcttctctattatttggatgtctggtatccctacaattatacatgcttccaacatttctgtcaacttttcctaagaagtttgttggaatgcgctttcatttttccatcccacacttgtttatcaaaaatacggtgtggtggggaagggagagagggggagagtctgagctcgtaggtaagatcttcttgctcagaggccatgcgacgggcttatcatacaggttgggtctagccctgggaagctcatgacaggtgagaatgaaacccgctccagttacttttgctgcataacaaatcatctcaaaactcagtggcttaaaaccatagtttctttgtgaaactcagggatgctgtgggttgggaattggggcagggcatgacaggaaggctgtctcttgtccaccatgtttaggccttagctgagagaacctgcaggtttcgagatttgctggcgggagctgcagcctcctggaggtgggctggcttatgtgtctggcgggtggtgttgactgctggctggaaccttggccgggctgcaggtcagagcaccagcacacacttctcaacgtggacagcatgagcttcctcacaatgtggcgactgggttccgagagtgagtgcacggcctgcccttgaccttgcctcagggtcacgcagtggcatctcccctgagccctgcttgtggaggatgtcacaagaggtctgcccagcacacagggtggggacacggtcctgtgacttagttaggggagtgccaaaggctttttgtagaggggggctagtgagtagagacacagtgttgtggctgtatttagaaaatacaatttgccacatgatctaaggttcacttttagctctgtgacctatcattctttccttgagttcagtaggaacatttcttgtctggcacagctgcctccggtttggtactttttaattaagtgcgaaaataagttccaccgtatctgttctccctggggtgtcgggatgtccagcttccaccggcctcatgggcagaggaagcagcagccagggcagggccaggtgtgcccgtacaggactggcagcccaaggcaaggggtcagggctctactcccacagacagagccctgcacttttgtctcctcatttttaaaaaatgaattaaatgatcattttcttaatgttagaaaggagggaatgaacccccttgtgaacctgctaaaagccaattatccacactgctcttaactttgcaattctacgggtttcgcagacccccaaaaccatccacagaccactgatgaagaccccgggactcactgccctcagagccttcatacggcagcacctaacccacctgcagcacgaggatctccctggagctcttgctccagcccagcccggttttgctgacagcccctctgcagcccagtggtatgcaggtgacatgtcccctgaggccacgcgtcatcacagcctgagggaagcagtggtttcaaccctgctgtgggttgaggacaattgtctagaggaaaggaccccatcctggcacttctcctttagctgagaggtgatactttcttttccaacatagtgagaaagcaacacttgcatatcaaccacattaagacatctgctttcagaaaagaaggcgttgtgcccaacatctgcatggcaccaaacatctgtactgtagccttgttgatgaccagagcaggcaaggcggcatctcccaggtgcccagcacttgagccccatgtttgatccccacagccaccctctatgacaggtgctgtcgctatccccagtttacagatgggagaactgaacagaagacataaggcatttgttcaagggtgcatggctggtgagtagtgaagccagctaagatggccatgaggctgagaaaaagagagtaataaggagaggagtccagatgccagcccctgttagtcctgagggtgccaaggtcatagggaggtgacatcagactggctgaattagtgtctcagggggcagccaacacttgtcactcaggaagtctcgcagggtagaggtcatcccgagcagccatggggtgctctctgctgccctgtgggaggaggaggaggaggatggagacgaacaatgctgtactggcatgtggaggggtggagcacactgggtacaggctcctaacctctgtcttggcctcattcccctcctctcctcctggatcccctgggctcacctggctgcttgcctgggcacagggacctgggacattatgacctccggctctctctagctgggacctcatggagggcggttcgctgttctctagcttggagcttggggcatctgtggatggtttgatttgtgtggtttctgtcttaaaagaatgtctagaagaagcggcagataaaaggcctggagctcactggagagttgggtttgagatacttcagccatggaagggagaactgaagagccaagctgtgtcattgcttcaggcaagaggacaccgatagggaaacagagggacaggcagcctgagggcatttctcacctgctgctgccaaaaagaatctgacagctgttcagaaaggcaggagaagaaaccctaagacgtgtcaagaaatccatgagaggggaacatctcaatggagaggtgagggggaggccggggccctgcagacgtcaggttgggtggcgagggtccccccacacaggtctctctgtgctcaagctccagtcaccatgctgtcaccacagttgctgtgtctgctggcagctggagggtgcacctgtgccttccactcagcaaactgagtttgagcaaatacggaaaaacaagtttattgcggctatgcttctggcagcgttcctgcccacaggccagagactggtgtatttcctccagtttggagcttctggtatgttctcggtgactggtcaaggctgggctatttcaggacttggagaacctcctcggcctgttattgctcgggaagtttccagaaggctgtagatgcgtagctggctgtccagtcccattgcatcttccctcttgagcaaatagctaaacgtgcgcttcatccctccactcaggctgtgctaataggaaaccaaagcggccaaggggctggacatgtggatggagggctctgcctcgcagcacctccaaaacagttgccacttacagagagcacactaagtgcagacgctgtgctgtgtgctctgcaaatgtcactcctcggcctcccctctgcaccgagacaactgctaccatgagaatcctgtcttgaggaagcccagaggggcaaggtgcctgcccaggtcacaaggttgatgagcaattggccaagtcactgttttatcaccacggaatcactgctggagtttggtaatggtcgttgtatgtgaatgcctctgtgctcccctacaaaatgactgaagcagactcagacctcaacggtgcattctagggatgccttccagttactgaatggcgtactggggttatgtgcattgccttgcttaattttcacgataaggcagtagagccacagttaaaatttggcctcagcaagtcccgggttcgaatgcggcttgtgcagcttttgagttgattaccctgtgtctcttgttcagcatctcagagcctgttttttcttcagggctgctttgagaattcagtgaatgaatgtatgggcaagacttaggacagtgcccggctcatagtcagctctcaagaaataggtctcagcatagtaataattatcattatatttagataattatgtagtccgttttacacatgagggaagtggggctaagagcagttcaggaacttgttcaagatcagccaactaataaataccagggacacccagctccatctgttgccaaagctgtcgcagcatcacgcacttcccgcagaacaccgtgctgtggctgtttatcttcttgaagttcctcagggagtcagtctcttttgtttcaggagctccctgacaccgtggtgaacttggccggtcatccaaacccactcccgcgcccagcccggggccatgacccctaagagggggagagcagtgttcattttgctcttcaccatcgttttgagtgctgtaaatggtaataatcctgatgcccagggctcagcttccaagaacaaggatgccctcagctccctgtccctgcctgcacctccggctgcttcctctcctgcaggaggaagggcagggaacaactgcttcaccactgataacagcaagagagcaacacgatgcggcggtcacgtcttccaccaaaaacaagctagagaagcacaatagctcagcacttcactggctgctgcctcccgttccctgctattttcatgaaccaattttctttatcttctgtctttggcaagggcagcatttttgaagatgcatgttaatgtttaaaatacccaatagctggtgcacaatttttctgtttcttttaattatctcgttcactttttcctctgtattcattgtagatcttctattcctctgccctctctaaaaatgcgttgcatatttatattgttataaaccctcctgtgctcttccagtaactgttctcagcataaccagagaggtgccctttccccactaaaattttaacagagcacagcttttaattaccttttccccatctccgacaggaaaatttccgaacataaaataataatcaaaaaacttccaagtataacttgcaacccgagagccagactcaacaaagataagtccccgtttctttcttctgaatatctaaagtttcctgcaagccccagtggtgcctctcacatgtcccaggcctctggccaggttccagcctcactcactgcttgctagatgtcccactggagcgtatgctctcggtgcccagcaagaaaaggtgctcccttctctgagccaggcctccccgcaagaccttggcaccttccgcctgttttcctgactgcctgtgggttgaggtggcatatgagaactacttgactgtcttttaaaactcatgttgcttcctttgacttcctatctgctgtgtcggccaaaatactgttattcaacagattgctagagggtgggaattggcatagagtttggtataaagtcaaggctggacacacaaaggagtccctggccatgcaggcacagagcacattcttgtggctgtcacccagctgtgccacatgaggtcacagtccttcgacctgctgtctccatgcctgtcccctccccaggctgcaggcgctggggttgccttccctgtaaactcctcctgtgactgtccccatcagcagccccaccatcccctgcttagctggcttggctcctcagaagcacctctgcagccagggccacatcctgctgactgcatggccttcaagccccccacaacccccgccatccctgtgcctccacctctatctcagctccttggatgctcccagcgtccaccagacaaccccagcctcctcagttggccctagaggcaccaaggtgtgccatcctctggcctttcttttttttttttttttttgagaccgagtctcgctcttgtctcctaggctggagtgcagtggcgtgatcttgtcactgcaacctctgccttctgggttcaagcgattctcctgcctcagcctcccaagtagctgggattacaggcgcttgccaccacgctcagctaattctcatatttttggtagagatggggtttcaccatgttggccaggctggtctcgaactcctgacctgaggtgatccgtccaccttggcctcccaaagtgctgggattacaggcatgagccaccctgcctggtcatcccactgcctttcttacctcaccaggcacctcgacccttggcccatccacactctggcccgcacctgctttttgctagatttacctgttccacacctctgaccactcccttggccacatcactcaccagcccaggccttttcattatccctatatcagcccagctcttgaggcccgccccctcctgtggagttacctcctgccctatcagctaatcaacagcaaagcttccctggtccatcatatctagtaccattgtttcaaaacaacattgcaactttctcctttttatttttcccctcttaaattaaaaagaaactcacaagtgatgcaataaatcaaataacagaaaagggtataacaaaactgaagtactgccctgtctccctctgaccctgcctgccctgagacctggtatcaacagtcgaggccctgtttatttctgtgctttcctgggactgtctgcaggtgctcccaggcctctgaggatccacttgtgtctgaacatctctacccagtgacaactatctccccagtctcaggtcacaaaaacatctttgtgtgtacctggtggagttaaagtgtacgattgtgttcaatcctttattcccaaagctggtgagtttttacctccccttctggtgctgaaaatagtacgtaacccatcagcgtgtgcagcgcagcatgtgcagggttctgcagattgaggttctcatgggttatcatggctaactttgcaaattgagtccctttctatctgcttcccatggtacctgacccagcgtttggtgtgtgcccaaccaatgcaaactgatcttaaatattgcctgaggcaaagagaattaagacgggaaatctgtttgaaagaagtggtgggacagccacctgtctccacatggcttaatcaagaaggtaactgaataaatgtgcacttacgggtcacatgtacaggtttacttcattttcatgaaatgacttgtatctctgtttaatgttgctttttgcaaatcaaattgtattccctttggctccttaaaatttcagagacaattttccataacttttaattgacctttaactggcactgaatcttaatttaagctttcaattgcttttgccaagtttttatactaatgttctactaaacagttaaggcccctagaggagcccccatcttaatcataacaaaaaaatctattactttaccatttgtataatgttttatagttttcctgtatagagtgtagtatgaataaacgccttcaaaattctcctttttaaatatcagatttctagatgattctttaaagtggagtaccacttgatttcaggcttcaggctgtgtgtgtgactgtgagtgtgtaagcacacaaacacacatggctttttctggatataactcataagctctcccttctgtaacatgtcagtgttccgtgcctgggcacagggatgctttcacacctagatcttgagagccagggctgcagcacagcctcatcgcaagcctccagtccctggccctccctggcccttgatctcctacacacctaccagcacctggcttctcaccttctgtctgggaaggtgggggctcacctggagccagccagacagctcaggtccacagaatcagtgtgtgcgctccagccagaagtccagcactgtagggccctgctttcaacccatgtgtgtccctggctgggggcactgagtaggtgttagtaaccctcaataacctttcttcaccttcccaaggagctgaccccttctctgtgtcttgacattactctttgtcgtctggaaatcacttaccgagttgcatgacgaccattggcttctgattgatcacttcctatgttctgtatcagaatcattttttggtcctcatttcagacccacagaagcaaaatctttgggggtggggcccacattttacattttgtggaactccctgattgtttctttgtatacagagttggagagctgagagaccctcagtggttcgggtgctctcccaaggcaaggcaggtggaggtcttggataggaatctcattttatttatttgacaaaaatatattgggaactaactaggtcctaggtatttcgtaaactatttaatattcagagatgagtaaacacattataaaaacagcaacataatcaccagatattgatgagatgcattagtcctttaaaagcgctcctatagctgtcatctcagcagctcagcgaggcagatggtacccttccaaaggtgcagaaacaaaacgcaggtggtggggatgcagagccgggccttcaccacacctgcagagtttgcacccagcagtgtggttggcgcaggatgtgttagaggaaggggagggggaagctgggcaggctgagggcactgggtggtggggagggccttccagaagagagacatcccagcagggcgacagcagcccatcacttccatggaggaaggaccagtgcacctttctcggcagatctgtctcccgcccaggccaggatgtttcagagcaaacgagacgttttgttcctaacagatccggctgtttggttttctccctgtgaggctgaactgattggagcctggccatccagaagggtcattggaatggaaagtgatccccccaacagagaggagtgcaggccacagatggaaacagcagagtgctagggggaacgtttgcagaagaaggcagtcaggaaaacgtaacagggatgccaaatccacatcccactgggctcctgaacattgcttgcttactcccagtcccaggagaaacccagcaaatccatctttccttaacataatctttcagcccagatcagccctaaattgtgtcctctaaaacctcttctcctcccacggtgttgtcccccaaatcagtctatgagcctctccccgagtacatgccaactgtccattggctattctttcctgcctcacacgggacgaccaccagggaagtgcctagaccgtctacctccatattccatggattccgtgagcatgacgattgttagtactgggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcattctgattttgcccatttggattccttgagccctgtgtctgaaaattagctgtggttgccataaccttaattatactcagcagggcagagttgcttgctgatttatgacgcacagttgtgacctgggagtagctgtcatcctcagctgctgacacggacacgacaacggcgctctgtgtctataacggggagtatcaattactttcctgcagcaggaagaacagctcagagtcttggaatgatctggacagaaacgttaaacacttgtctcgtataaattcagcccacatccatctgggctcattaaatcattgaattgctcagaagcaccaaattacatctttctaacaaattatatttttaaagctgcttgtttatttcacatctggaagttgaggcaaaagccaaaacttgcattcaaagtctgagaaatcatctcgccctttgccttcctttctttccttggggaagagagaggaggagcaggtgtttggaagaggtggaggatggcagaaggccacaggtaggatggcgctgatcctgtgggccctcgcagcctcagtttgtgtgtatgctgtctgatttcacagaccgctggctgcatcccggcagccatctgtcctccttgaaggagggccagcaggaagccctcacagagacgctgagctgggaggaaggaggtgcctccgcctgccctccttccttcccgcctgcatgtccctgagagcagagtctggttcgccggcagatagcccatgggaaccagtccaaccatcgtgcacccgtagatgctctgagacacttagagttggctggtattcgggactgcgacccagaacctggcctgttctgcttccccaggagtaggaacactgcacccccaagtcagcctcaggagcccatcctccatgcctcctcctcttgccagcctggtgcaagctgggcctgtgtgcccaggggctgtgcactccataggactgggccttggtctcctgtctgcacatttttcctgagcctggcaccaagccaaactgccccaaagccatggcttctgcgccccaggctctgtgaacacgtggggtggggaagggcaaaggcttcctccctgagcatgcactcagctcgattttcagacaccaatgtgcaagcattccctcccagagctgctgaaaatccacattccctagttcattccccctaagtagtatcaagtaggtccaggatgggcccagggaactgtggggggtcctgaagtatgtgagccacacttggagcaggtgtgcagtaatccctgtggcgatggggcttgcagactggtgcaggaggcaggatgggttgggtaaacaggtgaatggctgggcagtggaagatggtaagagctgggaaagggcaggcccggcgtggccacacagggaagggcgttctgggcagagggagcagcatatggaggagccctgaggtgggtgcacctggggtcgctagggcgcggcagggcagagctggtggagtgggaagggcgcagtgtggagggcctgggaatgctggggcgtttagactgtggcccctcctctgagagggatggggactgctggagccctctgagcctttgcccaaaaggagcctcagctgtgaggcaactcagtccaagcagggtgaaagcaggaggcccagagtgggcagccgccaggaccaggagccacccacaggagacctgcacggaggccaccagggaaggcatccagagccgcgggggccgtgtctcctagacagcctcggcgtctgtggagatgggtacccgggcagtccagtgctggttattgagtgccttcgccctgccaggcccatctcggtgctgctcagcaaagtgggtgtctgagggaccgtcagccaggggtttttaggcagagagaatagctgcaccctgcctgccacaaaatccaccacatgtgggatctgggctttagatgtgcggtccaacaccctggtggcccaggggcatcttctctcagcccttactgcacaatcctcacccacaaaagggctgggggtgcaggggcccagccaggcttcgggcaagcatgcccctgtggagtttccccagggcagagggaggcccagctagtgggagtggggatggggccctgcctgtcagactctaagcataagggccgagggcacaaggcccaactggttcgtccttggcagtgttttagaggaaggctctcctggggccaccacagctgcttttcagccttgttcctcctcctctgtggcttgcaggatgggtgtgggatagcagagcaggggggtgtgtgtgtatgtgtgtgtgtgtcctgtcaaacataatcatagccggacactagtgaaagtagtcagacaggttttaatcggcaacataactgacatttgcaatggggaatagggtccaggctgagctgagctcaggttcaattggcacacaagtgactgggggtttccaagagagaatgagggagcagggaggcagcgagtgggggctcaggagagtgggggaagtgaaaagttacagatggtggaagcgggtggtccgtgtgaacacatctggacatgctgacgtgctcactgaagtcaggagacagtgtgtggctgtcctcaggtgtggctggaacccacagtcgattcttttggctgccgtgaggtttctcaggcaggcactttaaaggggactggggtcagcctagggatgccaccttgagctgttagaagctatgttagtggttgttcaagttgttataggcagaggtgaggcccagccaagaagagggctcagaggagccaggctggagtgtggtcgaggagagaactcttggtcagtgccacagctaagtgttgccaggagcacctgccacagcccagagagcccctggggtgcactcagagctccagcacctgccacgcagcacaccccatgcccctgggtccctgcaggcggaggccatgcagggaagaccccagggaaggctcctgtctctgattccacactacagcatattggtctgaagacagggactccaaagaggcctcagaggctgcagggggcccaagtcttgtggaaatgagatgtggggaaagttgggccttattgatgttgatgttgtggcctcagccagttccaatgctaaggcactgggaaaaaaatcttatgatttttggagcacatttaaaaataaggacaggttaggcacggtggctcatgctcgtaatcccagcacttggagagcctgaggccagcggatcacttgcactcaggagttcaagaccagcctgggcaacatagcaagaccccatctctacaaaaaaaaattagaaattggctgggcatggtggtatgtgccttggtcccagctattcgggaggctgaggtgggaggcttacttgagcctgggagctcaaggcttcggtgagctaggatcataccacggcactccagcctgggtggaagagcaagaccctgtctcaaaaaaataaggacaatttacataaacaatgttccaagtacctttcacacatcacattgggccccaacctgtgaggtggtgctgcagttgaggagcgtgcttttcagaggaacctgcagagggagaggtgaggacacgagcccagggtcttgacactgggatggggcaaatggggacacagtttttcctgaccctcccccgcccctgcccctgggaggccgcagtctaggtgggtgggccagggcaggagcgtggatatgagatggggggctgtgcttgggtggagaatcttcaagggagtgaaacagtccagcttcttcgtagatcagcgtctaaaaggacagcagggggaaatgccttttaaattttttttattaaaaaatgaaaaatttccagagttttgaaaaaattaaaaataaagataaatagaaattgtataaagtgggaaaatagcagcaaataacaataatttacaccgagggaagaagagaaagcacgacccagcagatggagattgtctgtgtggggctcacccactgtgctgtttccccaggtaccgcgtggtggtctcgtacccaccccagagtgaggcggagatcgagctgaaggaaggcgacatcgtctttgtgcacaagaagcgtgaggacggctggtacaaggggaccctgcagcggaacggccgcacaggcctcttcccgggcagcttcgtcgagagcttctgagaactggtgctccctgcacccagctcacagagggggaggccgcctgggaagctccacggcacacagagagggagccatggcgccccaagggttccaggtcatctccaaggcacctggcgggggataccctggcccagggtgggggccagggactgtggaggtcgtgccttctcccaaaacccccaaacggagagcacacctgggatgttcttcaaggaaatgcccaccccctctgtggaaactgcaaagaaagcaccttgaggaagagaggcaggtgccggcgcaggcaggcctgtggctgtggtttgcagccatggcagcgttctcatttaccacctaagcagggttggaggttgcaggaggtctgcaggcgaggtgggtggcatgggggccaggagcgctggagatcatctttctgggctgccctgggcttcccgcggggcccaggttgctctgtcaccattctatatacctcagtcacctgccgcccggctgctcagcaggggtgtttgtgaggccctgggggtgccccggaaggggcaccccaccgcccctgttgggaaccagagcagaatctgtgggcttgtcgcctgccagtagtataagcaacactttctgttcaccaccattgtcccttgcattacttctttcttacagcatatttttaacataaagctgttagactttatatatttctaataggtcagacattgcctatttttcatacatctggtgctgcctttttgtaaaactaataatgacttggttgagcttgaaagaaaagatgtctgaggcgacatcaaaggggcagaatttttatatttcccatatggctttgggagagcgccgagaagccgccatcccgcacctcagcgctggccagtactctgggggctggcggggtggatccattgagggggtcggagggagcttggaagcagccggtttctttaaactcttaccaaaaccccgcgctctgtctagacggtgatgattattattcaagacctggaaacatttcgaggaagggccactataattgtccttttgtgtggcggtagaaggagcacgcaggtcaaccccagccgggaaggcaaaatcttccctttattgcctcagagagaactgcaattagcattctcagaagatgatttcttggtatcaaaatgtgcagtttctacaacagtttagatcaccaccaccatttttcttcttttttaaaaataaataactgctcccatttcaggcagtgcaaaccttcatctgctggagaccagaggtacaaggagatcagggggttgcagcaccgctgcaggcttgcaagatcggggagttgggagggcgagagaggaggaggtgcagctttgatgctgggacctccctgagtggggctgatgaatgtatattcattagcaccatggctcacttcccaggaagactgatcaggagcccttcagggacaattttgttctcaagattcacaccttaggaacacatttttatcacctcaaaattttgatccatcacccctctctccacctatatttttacaaataccattcagacttaaattaagctgaagaaactagcctttggtaacatagggtgtcattggttttcagggatgtaaccaattccagaaatacattcttttgcctggcatgaagactttgaaacacgggccgcttattttcagagttcctgttttgggacgtgacttggctacttgttacttccaggtggttaccacacggcgggggtcatgcctttccctcccccaagatgataatagatttaatagactcaaagaagttgttcagaatcaaagaagaaaaagtctggcttaaacatagtaacttctgtgtgccaggttaatgacaaccaaaagctctctatttaccattattgccaaacttcatcagttgcccatcctgcaccaaaatcctgtgcgtgtttaaattcacgttgtcaccaaagaggtgcacagatcaacaacctggatgacgcaggtgttctccagggaaaccagaccaagtcaagtctccaggtaacttttttgaagtcttttttttaaggcgcgcaggtaccaagcaacagaatagagtaacctgaacgttcttactctcccaggcatggcccacgtggtgcttcaggtagaaatgtgcttcaccctcctggtggggggcgaggacacagcccactgcatgcagcatggtagagagctggggcgaatatctccatgtctttggaggatgtcagctggccgctttcagggcagagtcgggtgggcgttggtgccaccttaggaaggagagcgatgcgtgggtctggccagagctctggagccaatgccgggctgcctgagagcagaggaaatgcatggcccatgtgcatttctgagtattttaaactcgttcaggccctgcagccttcatgatgatgtagcttgcagagaagagcaggagcagaattagccctttcttcaggccatcttgcctcaaagggtacacatgtttggcggttaagatgaaactaacccttatgtttcatcctggccccatgatgtacacatcttagccatgtagtggccttggggggccacagagatttcctttgaggagcatggtagagtccacagccatggctgaagtcagtggacaccgaggggacaggactgcaggccaccaggggcctctgcccagagggaggcagagaggatggcggccacgggtgctctcctggcatcctcatggggtgatgccaggccgggcacttcaaaacaggctcagccgactgggagatcctttgtactttgcacagttcacacacacaaacacacacaccctatcccaagtgtttttgttagacacaaatgtcagcgtgtgattttggaagacttgtcagtgatgacaaaccatgatgcctgtgtttctgagtctttaaataaaaatgaacatgg

SEQ ID NO: 1533 - DNA, 305425 bp, Homo sapiens
cggcggagcgcgggtccctctcctgagcatcagtgagcgcccggagccgtggccgctgggggttgcggcggcgctgagccagcggggccggtgagtactagccgcgccgccagcccgcccgccggccggctctttgcgcctcagccgcgtggtctgaagggatgggcgggcgagcgcgggggtccggcagtccgtcgtgggggcacgggactgcctttctgggaaggcgtgctgcgtcttcgccgcgggggccccggtcccctcgtcgcgtgtcctgtccccagcccaggagggacgtcctggcctgtcctgcccggcccggagcggtgggaccggtgccgcaggtggcagcggcaggtggccgcctcctcccctccgggcccgagggttgtcgcagggacccgggactgagagccaggtggctcccgacagctgcggccctggaggcgaccccagccctcgccgcagtgggacaggtgcgcgggcacgcccggccccggctcctgggtctcgggagcctcccgcaccctccctgttgtgccttgggggtgctgcgtggtgcagaggaccgagaagcccttcgccctcggcgtccgccgcgctcccgccccttcctggccggggtgacaggggaagggctagggctgcgcatcccgggtcagctggggcgccgcggcgcagtgcacctggaaggcccgggggcagcgcgcggtgcccgtgggtttcccggtggtgcggacctgcgggcgtgcggaagtaacgacctccttccccagtgcccatgcaaggaaattagtgttatgtgcttgctttttttttttttttttcctaaggaagtttgactctgaatatcttattttgctggagctccatttgccagcacgtaagtttatgtaataagcggcatacagttcggaaaaaaattttcctgtgaaagtgctcttccttgccctctgcaggaagaattacgccgagctggttggcaggcttatccaccagcaactgtaggagctgcaggcagcagataaagtgttttttgagtaagggcacaagtcagcccttcaggacaatttttgtttttggaagattctgttatccagttccaaacaccgtgttatttcagtgttgaagatgggggaggagggaggagcacaggcttgtcaatcctaatacctcaacagaaattagctttgcaggattaactctccaagcaagcgagttgaatttggtagcccaaactacagctgaagctgagcctccatactaaagcctgtctcagttttaatagtttttcgcttgattcgtttgcctcttccaagtaggtgatcttattgtctgttaaacaacagatgtctctcatgtttttacttttttccttgtcttccatagattactctcgctgcagtgttgactattgaggttaaataggaatctttgtcttgggcttggttttagggagcattccctctgtatcttcaccgagtgtattctatcacattaagtacatttctgtttatgcctaattactaagagtttaaaaagtcaagggtgggtgttgggttttttgcccaaatgcttttgtgtagcatgcattgatatgatcatgtagattttcgtcttaaaattgttaacataagtggtggtcacattgctagattttctttctctaaaaccctgggctaatttaaaatgcacttttggattgttcacatcaataagctagcatcttatttagggttttggtatctgagtttggcatatagtttaccccatttttatctgtgttcataacaaggatcaggctgtcctctctgattaaattgggaaactttccatcattttctatgctctggaatagaagaattatctgttccctcaagtttggcagaacttgactgcagactgcctgggctgctgctggtgttgtttaggcagttaatatcagtatttaattaccttttcatttttttcatgatcatttatttttctcagtttttctgtttcttcaaagtaaatttaatattttctgttttcctagaaaatcattaacattattgaaatttaatatatgctagcataatgttgtatatagtattctggtgtaagaaaacagactcttacatatctgtatgtatctgtatgttctctttctgatacagtactttttttggtaccttttctctttttttttgatcagacttgcttaatgattattttattaatcctttcaaagaaccagcttttattaaccaggatttattgattaattctattgattttttatttttctatgacattaatttctgttttttatctttctacttaatttgagtttattttgttcaagttttaactgtttgaatggaaaacctggctcatttatttaatcagtcctgtgaacaaggcaaggacttctaattctttcattccacttacctcacatttggccttaattgtatttttacttcaacccttccaacgagacattattgctattgtttttgttattttctaggtcaacatttattagctttatctacctgtttaccatttcttcactttccattccttcttgtatcacagatacttttctttggaacatttttcttctccctcaagtacattctttagaaattacttcagcaatgatcaattttctgtttttgtaatatctgaaaatgcctttattctccctgtattctagaattttggtttcaccatgtgtcttctattgatttcagagttatttttgtatttttttatatttttaaaaagatgttttgtagctggaaggtttttaggatctctattctgccacagtgctgaaagaaaaacaaagattaagaacagattaatttgcagtccactgtcagtcacgactgttccctgaactcttagtatattgggtatacagttctatattaatctcaagtttattgatggtaattcaggttttctgcatccttaacttattttttttctctgtttgacctgttgatatggagagttgtattgaagactcccattatgattcttgtaggggtttttgtactatttctatgtttaatatatatttttctttaaatgttgtatttttgaagctgttttatgtgcttaaaggttcacaattcttgtatcttcttggtgaattgtaccttttgggaataaacgagccatcttatttaattttttttttgttcattctctttatattgctgtacttgctttttgttagcatttatatggaatatctttttctagtcactgattttcaattttctgtgtcttctttaattgttactcttaccattagcttatggctggattttgtttaattagttaatctttgtcttttaataaatattgtggtaaaataacataaaatttattatttattatttttatttttaccatttactacttttaagtttacagttccccagtgttaagtgtgtgcacattgttatgcaaccaatctccagaattttttcatcttacaaaattgaagctctgtatccattaccgcagcccctggcaaccaccattctgctttttgtctctatgaatttgcctattttaggtaccttgcatgagtatctaatatagtacctcatatagtatttgtctttttataactggcttatttcatttaatgtaatgccctcaaggttcatccatgttgtagcatgtgtcagaattttcttcatttttattgctaattaatattccattgaatgtatacaccacattttgcttatccatatatttatcaaaggatatttatgttggttccacatcatagctattatgaataatgctgccatgatcatgggtgtacaaatatctcttcaagaccctgctttcagttatttgggtatatacccagaagtagaattgttggatcaagtagtacttctatttttaattttttgatgacccagcatagtgttttccgcagaggctgaaccattttatattctcaccagcaatgcgtgagaatttcagtttccatacatccttgctaacatctgttattctctctctttttttgatagtagctatccttatgggtgtgaaatctttgtcttttaataggtagctttagcccatttatatttattttgattactgatcttttgcggattattcctgtcatcttattttatatttttgatttccttttttgagacggagtcttgctctatcgtccaggctggagtgcagtggcacgatctccgctcactgcgacctccggctttcgggttcaaacgattctcccaacccagcctcccgagtagctggaattacaggcctgcaaccactatgcccggctaatttttgtgtttttagtggggacaggttttaaccgtgttggccaggctagtctcaaatttctgacctcaagtgatctgcctgccttacccgcccaaagtgctgagattacaggcatgaaccactgtgccgagctggttcatttcattctcattgctgtgtatatgccattgtatatatccctaatatagatatacatttgactttgattggcagttggttgtttgcatttttggactattatgaatagtaagtacatgaacactctagtacacgtcttttgttgagtgagtgtgtgcatttctgttgagtgtgtatctgggagtggaactgcttggttgtagtctgtgcatgtgctcggttttagtagatactagcaaacagttttcagtaccggttgcaccaacttatttaccccagaagtatatgtggttgctccacattcttgccaactcttggtaatttctgtcttttaccttttagttattctggtggatactgtggttttaatttggattttcctgatgataaatgaatttgcactgttttggtacccttagtttttcacacatatctaaacatttttttctcttgctattaaaagataatctgtttatgtgaactctccatgagtaaagcaaaaaagaatcttatcatgattttaattctgtcccatattaaatttttgggttttcatacattatgcataaacagttatttaggtaaactgtaaatttttctgattatttactcatcattggtgcttttatttcatttgttttcttaatgagtccttaagtgattatttggttttgttttcagggattctgtgaatggtaaactttctgaacccttgcatgtttaaacaatgttttttatttcacttttccatgtgaatattcttgactgggtataggattctacgttaaaaccttctgaattttggagatattgctttatctgctggtatctaggaagaagtgcacgcgtctgactctcgtttctttgtagttaatgtttattttctctgaagctttacaattttttttctttctccttggtgttctaaaatttaactattatttgtctaggagtggattttttttttgagatggaatcttgctctgtcacccaggctgggagtgtggcatgatctcggctcactacaacctccacctcctggtttcaagtgattctcctgccttagcctcccaagtagttgggattacagatgtgcaccaccatacccagctaatgtttgtatttttagtacagacagggtttcaccatgttggcctgactgatctcaaactcctgacctcaggtgatccacctgcctcggcctcccaaagtgctgggattacaggcatgagccactgcgcttgggcaccacactggcttaagagtggatctcttttgttcttcctgctcagcatttggtagtccgtttcattctaaagattaatacacatttctatggcactggagaagttttgagtgtttccttgcctctattctattttctgcttctggaattattcttacttgggaattagaatatcttgatttatctttcatgtttcttgaaataagcatttttttctctcaaatattctgtcttttttaatttaattttttttttttttgagacagagtattgctgtgttgcccaggcctggagtgcaatggtgtggttcaatgtgacctgcaactcttggactcaggcaattcccctgccataccactgtgcccagcggaaatgctctctttatctttatgggctgcattctgggatgttccttgggctggttttgcaggtcaccaatctaatatttagatttgttccgtcaactctttagcccatctcttgagtgtttttaaatattgattatcatatttttaactttccgggtctctattttttttttttttttttgaggtggagtctcgctctgtcgcccaggctggaaggcaatggcactatctcggctcactgcaagctctgcctcccaggttcacgccattctcctgcctcagcctccccagtagcgaggactgccggtgcccaccaccacgcccggctaattttttgtatttttagtagcgacggggtttcactgtgttaaccaggatgatctcgatctcctgacctcgtgatccgcccgcctcggcctcccaaagtgctggggttacaggcgtgagccaccacgcctggccacgggtttctacttcttaaagtttaacttttgaaataggtaagataggcagggcgcagtggctcacgtctgtaatcccagcactttgggaggccgaggcggatggatcacgaggtcaggagattgagaccatctggctaacatggtgaaactccgcttctactaaaaaaaaaataaaataaaaaattagctgggcgtggtggcgattgcctgtagtcccagctactcaggaggttgaggcaggagaatggtgtgaacccgggaggcggagcttgcagtgagccaggatggcaccactgcactccagtctgggcgacagagagcgactccatctcaaaaaaaaaaaaaaaaaataggtaagataatcagtgttcaaaaccagactgtattaaaaaggcataaatgaaagtgagaggtgacagcgtgctggcagtcctcgctcgctctcggtgcctcctcagccttagtgcccactctggccgcgcttgaggagcccttcagcccaccgctgcactgtgggagcccctttctgggctggccaaggctggagccagctccctcagctttgcagggaggtgtggagggagaggcgcgggcgggaaccggggctgtacgcggtgcttgcgggccagcgtgagttcccggtgggcgtgggcttggcgggccccgcactgggagcggccggccagccggccccaacggccccaggcagtgaggggcttagcacctgggccagcagctgctgtgcccgatttctcgctgggccttagctgcctccctgcggggcagcgctcatgacctgcggcccgccatgcctgagccacccccacctcctgggctcctgtgcggcccgagcctccctgacagcaccaccccctgctccacggcgcccagtcccatcgaccaccagagggctgaggagtgcgggcgcagggcgcgggactggcaggcagctccacctgtggcactgatgccggatccactgggtgaagccagctgggctcctgagtctggtggggacttgagaacctttatgtctagctaagggattgtaaatacaccagtcagcaccctgtgtctagctcagggattgtaaacgcaccaatcagcactctgtcaaaatggaccaatcagctctctgaaaaatggaccaatcggttctctgtaaaatggagcagtcggctctctgtaaaatggaccaatcagcaggatatgggtgtggccagataagagaataaaagcaggctgcccgagccaagagtggtaacgtgctgcggtcgcattccgcgctgctgaaggtttgtccttttgatgtttggaatgcgttcttattactgctcactctttgggtctgcactgtctatatgagctgcaacacacacctcgaaggtctgcagcttcactcctgaagctagcgagaccacgaactcaccaggaggaacgaacaactctagatgcgcccccttaagagctgtaacactcgccgcgaaggtctgcagcttcactcctgagtcagcgagactacgaacccaccagaaggaagaaactccgaacacatccaaacatcagaaggaacaaactccagacacaccgcctttaagaactgttacgctcaccgcgagggtccacggcttcattctccaagtcagaccaagaacccaccaattccggacacaaaaggtgttcccaccattcctgtcctcttacttctctcgccttacaagtaggtaaccattgttgttagttacttatgtaccttccaaagtttcttcatgcaaatacaagcaaatatgaatcagattctccatttctccttttttgcacaaatagtagcattattctctatctggtcttcatcctgtgtttttatttcttggtatatcacaaagatcgtcacataccaactgcttgctctttataatgtccccttaggtcttcccaagaatatctaataatttcttctatgtgctctagtaattatctttgcttgggtttgtgttctgttgattcagtgtccctgtttcatcatactgaataaaaacttggtgattctttatgtgttcatcttcgaagtttgagaattccttttttcctgtcttactaggcgtagcgtgcctcctgtgattgttgaagagctgtggtgtgctgctgagtggcgtgtgtattccatgtgaggggaagggtccaacagtcctggtcattcagactgcagttccccaggtaatcaccttgtcaggttctacctctgctgttctatctgctgttacaagtctgttcctggaaacctgttaccatttccttctgcataacagcctcctcccaagcttgtattgggctatggtttgctcaggtaatctggttctgagtactttttacttttcagaaatttcctagacattttagttggccatcggcactcttgttttccaggtttcttttgatttagtgttttaaaaatgtttctaccattccattgaattttaagacacttggaaggcagaagtatgtgtttagtttattgttttggggacagggtcttgctctgtctcccaggttagagtgcattggcgcagtcataggtcactgtaactttgaacttttgggcttaactggtcctcctgcctcggcctcccaaagcgctgagattaccggcatgggccaccatgcccagtccttggtcttttataatttatttctgtgttgggggcccccaggaccatgctcagatctggtggttcacttggaagactcagcatgtggtgtactcacggctgtaatttattacagtgaaaggatacaaagcacaatcagcaaagggaaaggtgcatggggccaagtccaaaggaagccaggcacaagcttccaagcatcctctcccagtgcagtcacacaggatgtatgtgcttaactccccgaggaaggagctgtgacaacgcatgtgaaatgctgtctaccagggaaactcactagagacccaacacccagggtttttattgggggctggtcatgcaggccccctttgcccagcacataccacattccacgctacctgaagaaaagcaggagttcagcataaaccacacaataatttaggcacagtgagtccctctttccaggttggatggtgggaacccttctgaaatctaagttcccaggtgccagccaaggattaaccatgctttttatgagactttttaagaataacagtcttgggccaagcacaatggctcatgtctataatcccaacactgtgggagaccaaggtgggaggatctcttgaagccaggaatttgagactagcctggccaatacagaagaccctatcattcatttatttatttatttatttatttatttatttatttatttatttatttatttattttaaaaagcagtcttaggcctgctgtgttaactcttttctgtaagattttcctcctgtgttcctcagaaaaagatggacactttacctagaaatgacttctcccagtcagatggtcatgaatttttttgccttctctgaagagagaacacatttgtattaaggtgaaactgagtggagaacatttcctgatgttggagaaagccatagcatggcacgtgctcagcagccttgagagggtgtcagtgagagagcacagagggactactcaaccattcaaaattattttgaaaaggcaaggatccttttgaactttatctgcaaattccatgaggtgagaagtttagctcaatatagctggaaagttgagattgggttctgtgctgatagcaggaatgacacgaaagagctgaataaaaaatccacacatggtctttaattagccatatacagatggtagtggcccatcatccagctcagagatctgccacttctcttccagctttcccacggagccaccctgatcacccccatccatgttggtctttcttccccaaatggccatcagctctgctcacagggcctttcatcactggcttctttgtcactggcttcttttccgtggttttattggatagtttttgttgcctcattgtgtataatcttccacaagattgggaattccttgaggaatgaacagtaagtcatagttatataccccatgtctccctgcagggtgacatgcatagagctggtgcctattaatgttttcggaaagaaccactagaaggaagtaagaagcagccttttcttcattctagtcactgcttcacatgcagctgatttttattctgtgttgagggtggtgatataaaacaccacgctgacattacctgtttgagttgtctgagttctgtctgcagcagatggtgtaattaaatgttttagtttgaaaggcttttcaatttcattcaatctgagtgtgggcttagattgtcaaatcatcttttctaactctaaaggctgtatctagtcagcctggatctagtttcctccctttctctgtttttttattttttttatttttttgagacagagtcttactctgtcacccaggctggagtgcaatggtgtgatctcggctccctgcaacctccgcctcctgggttcaagtgattctcctgcctcagcctccagagtagctaactacaggcatgtgccaccacacctgggtaattcttgtattttttgtagagatgggctttcactgtgttggccaggctgatctcaaactcctaatcttgtgatccgcccgcctcagcctcccaaagtgctgggattacaggcgtgagcctccacgcctggccctccctttccttggttttagacctcaggtgtgaggaattgaattaattatattctcattcttagccctttatcatcactggcccatgcaagcccctctgttgttttgcttgttaatgcatttgttggtttatttgttcattccgttttatcccactctcattctcttctccctatagacagctattctaatgaggttcatataatacttttgtgtatatacagttgacccgtgaacaatgagggggtcaggggaactgattgcctgcacagttgaaaatctgtgtataacttttgactcccaaaacttaactactgacagcctactgttgagtggaagccttacccataatataaacagtcaattaacatttattttgcgtgtgatgtgtattatgtaccatattcttagaataatgtaagctagagataaagaaaatcataaggaagagaaaatatacttttcattagttccttggaattggattatcataaaagtcttcatccttgtcatcttcatgttgagtaggctgagggggaggaggaagaagaggggttggtcttgctgtcttgggggtagcagaagtggaagaaaatccacatgtaagtggacacaggcagttcaaacctgtgctattcaagggtcacgcgtatactgctttgtgtgcatctatttttaatttacatgaatggcatcatgttctagcctttattctgtatcttaggattgtcactcaccacccatctctgttacttggtgattctggtcttaatatccaccacattttgtccatctcgtctcctgtagatggacacccaggttgattcccactcccagtaatgctgaatgagcctcgtacatgtctccttatggacttgtgtgagaattctttgggatttagacccaggagtaggactgcctggtcgtggtgtgtgcctatacttaatataaccaagtactgccagattgctgtcaagggtggctgcaccactaccttccccagcagcacacaaggattcccaaggctctgatatatatatatataatataataatatatatatatatatatatttttttgtacttttagtagagaccgggtttcactgtgtcggccaggatggtcttgatctcttgacctcatgatccgcccgccttggcctcccaaagtggtgggattacaggcgtgagccactgcacccggccatcccaaggccctgatctttgcatgcgcttggcatcattcaactttctagactttagcagtctctctctttttatttatttactatttattattattataattataattattattatattttttgagatggagtttcactcagtcgcccaggctggagtgcagtggcatggtctcggctcactgcaatctccgcctcctgggttcatgccattctcctgcctcaacctcctgagtagctgggactactggtgcccaccactacgcctggctaattttttgtgttttcagtagagacggggtttcaccatgttagccaggatggtctcgatctcctgacttcatgatccgcccgcctcggcctcccaaagtgctgggattacaggtgtgagccactgtgcccggcagcagtttccctctttttatttgcatctgtctgtttactactgaatttgagaatgcttttatatatgcttgttatctttttgagtttccattgacataagttgcctgttcatgtcctttccccatgtttcaactggaatccaatatagactattttagacattagccccttgttgatgtttcgacagtgcacatagtttctcctaatatgttatacgtcagctttttggttggtatctgtgttggataagaatccttaattctataacctgaatagtcaatctgccccatgaacttacttagttttaccttttgacatgtctgttgacaacatttagtaatcaagatatttcacataaaaatccagattcctagtctctcttgaaagggtgaaaagtatttcagtcctggctagagtgactgaggggtgagctcctgctgttgctagggcctgggctgcctacccacctgtcctcactcattctcttgacctcctggccactagtgtcatttgactttatgaccagccactgctgtatgtgaggcaataccttaaggataaacaagcatggtgatgatgttcccaagattgcttggacatggttatggagtgggtggactcggcattgagaacacagtagtagctgctgcatctcatgacactattggatgggtgtcagcatggcagcagaatactgacggactgtgtgcacattctttcagcagtaatgattcattcttttcaaccttttctggatcggctcattcctttttgccaaaaaaaaccaaacaaacccaaaaaactatggtttagtgaaattgcatatgaacaagagttctaaacgagggatctgaaaactttttctgtgaagagctatagagtaaatattttaggctttgcagggccgtgtgttcccttggaactacttagctctgctcctgtagtgtgaaagctgctataggttgtatgtaaatgaacatggtctcttcatttggtctggatttgggctgcagactgtagtttctgatccatgttctaaaccatagtcttaagacttaattttgtcttccttctcttgtttttaaggtgcaaggttatacataacattttgctaatgaatacatggtaagtacctactaggtactaggtgctgagattatagtgatggacaagacacaaatccagtctattcagcttaatgtctgggtggggagacagatgagggagcaggcaattactaaagaggatggcaggccaggacacgggagagcacacaattgggcagcaggggttgggagcagggcatgtcaggtaagacgttctagaagaaggtgatgtctaaatgaagggggaagagggcgaggcaggataatgcaaaggtccttttgaacttcatctgcaaattccatggggtgagagtatagctggaaagctgagattgggttctgtgctgatagcaggaatgacaagaaagactctgaataaaaaatccacacgtggaatcgtgaatgcttaaataatccaaggttgatggtggtaactcctatgctattcaaatgtggcagaaaataaaaaaaaaaaacatggaaagcatctcagctgattttacaaagttaaaataaccctgatagagagcagtatatggatactgggggttggaaattttaaaaaaatgaaaaaaagaacagtataagcccgtagatgtaaactatagaccaaatttacgtgtgatgtgtatacaaatatcctaaatagcaaaaggaggtcagcagaatattaaaagagcaatacactttgacgaaatatattttactctaggaattccagaatcgtttgctattaggacatatgttagtttaatacaaggggaaagtttagtaagtttccattttatttaataaaatggggtagctatataatcgtcttgagagattctggaaaagcacttagaatttgacttcaaatcttgtcatttcttgaaacgttttcatgcattgtgccttcaggttgtacagcgtggctgagtttaccactttttaatttctctggcaaatctttgctgattatagcttttcattcatcacgtcctttgtgaatccattcttgtttactctatgcggaataaatttttctcttctcttctagtccagtaattctccattctttcatttcaattggagttttcagtttctctcaattgctttccttttttgagagacagattaggcactggagatacaaagataaataagatagtactcagggttttttctctttatcctctgattcattttctacccttccatatttctctgtctcagagggagatgattcctacaaacttcattttgcagtgttccttgtcactgtctctggccaagtatggctagtaggaagcactagtgggagattgaaaggtgggaggaagggagaagtcagggtttttcccccttgttttctgctttgcacagtgtctctagggtggtcccagctccagccaaggactctgacactggcttgtggactctgataatagcccctcctttatccttccagcttcatgggtggtaggtagatggggtcccactgttgctaatctctgggttggctcaccatcccaactggctttttagtcctgccctaaaccttgtaattagttcccatattaaattcctgctattgaactgcttctcttgaattctatttttcttattaaactttgcacaatgtagataaaaaccctacttctgtgtgttcacaatctcataggaaaagcggacattaaaatgactataagtttagcctagtcagtgttccctcttcccttcttttggaagtagacttcactttgtgcatagcaattggccatgacccagaatgagccaatcaaaatttggacatgggcacacacagagaaaagatgatgtgaagacgcagggagaagatggccacctgccagccaaggagagaggcctgggacagagccttgcctcagggccctcagaaagaaccagctctgctgacaccttgatctcagagtcctagtctccagaactgtgaggaaatcaatttctatgtttaagctccccagtttgtggtactttgttccagtagttctgggaaagtagtgtactacctgtcctcccagccccacccaaccactaatctactttctgtctctatagatttccctattctggtcatttccgatgcatggaatcataatctgtggtcatttgtgactggcttctttcacttagcataaggtttccgagattcatccttgtagcatgtagctggatgtcactccttgtatgggcagataatattctagtgtatggataataccgcatgttatttacctgttcatcagatgatgggcatatgggttcttaccacctttgctgttatgaataatgttgctataaatgcccatgtacaagtttttatgtggatatatgttttcatttttttggttatagacccaggaggaatattcctgggtcatacggtaactctgtatttaataatttgaggagctgccagactgttttccaaagtggctgcatcactttacattcccaacagcagcgaatgaggtttctgattttttcacatccttaccaacatttgttattacctttttattctagccatcctagtgcatatgaagtggtgtctacattctacattgtggttttgatttatatttccctgatgactagtgatgttgagcatcttttcgtgtctttattggccaattgtatatagtctttagataagtgtatattcaaggcttttacccatttttgaattgggttgttttgttgttgttcttgagttgtaggagttctttatatattataaatattaaatatttatcagatatatataatttgcagatattttatttcttccattatgtgggttgtcttaattttcttttttttcctttttttgttgacgtaataattatacatatttatgaggtacagagtgataatttgatacatgtatgcaatgtgtaatgattgaatcagggtaattaggatatccatcatcacaaacatttatcattcctttgtgctgggaacatccaaaatctcttctagctttttgaacatgtacaataagttattggtaactatactcgccctacagttctatagaacactaaaacttattcttcttacatagctgtaaatttttatccattaacttttcccaagcctccccttctaattctgtgaccccattttctttttagcacccatgtctgagtgagaacatgtactgtttatctttttgtgctttacttatttcattaaatataatgtcctccaggttcatccatgttgctgggatgacaggatttcattcttctttaatggctgaatagtattctattgagtgtatatgccacattttctttatccattcatctgttgatgcacatttagatttattccctgtcttggctgttgtgaacagtgttgcaattaacatgagagtgcatatatttcttcagtatactgacttctttcctttggataaatacccagtagtagggttgctggatcatatggtagttctattttcagttttttgaaaaacctcagtattattttccataatggccattaccaatttgcatccctacccacagtgtataggagttcccctttctccaaatctttgccagcatccattatattttgtctttttgatagtagccattctaactggagtgagaggatatctcatagtggtcttgatttttatttctctgatgattagtgatggtgagcattttttcatacttgttggctattttatacttgcaaggctcccagaatagccaaaacaaacttgaaaaacaagaacaaagtgtaggatgactcacacttcccaatttaaaaatttatacactaacaagtaatcaagacagtgtggtactggcagaatgatagtgacatttgtatgtcttcctttgagaatgtttattcagatcttttgcccatataaaaaccagattatttgcttttttgctgttgagttgttttagtcacttgtgtgttctggatactagtcccttgatggatggatagtttgcaaatattttctcccattctacaggttgtcttttcattctgttgtttcctttgctgtgcaggagctttttagtttaataaagtgctatttttccatttttgtttttgttgcctgtgtttttgaggttttagccataagatctttgcctggaccaatgtcctgaagcgtttttccttatgttttctaccagtagttttatagttttgggtcttacattcaagtctttaattcagtctgagttgatttttctatatggtgagagataggggtctagttttattcttctgcatatcgatatccagttttcctagtatcatttattgaaggggtgtcattgtcaaaaatcagttgactataaatatgtggatttatttttgggttctttattctgttccattggtctatgtgtctgtttttctactagtaccatgctgttttggttactgttgctttgaagtcaggtagtatgatgcctccagctttgttctttttgcttaatattgccttggctattttggctttccatttcttgatggtgtcctttccagcacaaaggtttttcattttggtaggtacaatttaccctattttaccttagttggtcatgcttttggtgtcatgtctaagaattctttgtcaaacctaacgtctttaagatttacccgtatgtttccttctaagagttttacagtcgtaactcttacgtttaagtcatcaattcatttttgaattaatttttgcatatggtgtgatggagggtccaacttcattttttttttcatgtgactatctgattatcccagacctatttgttgaaaagaatggtcttgttgacctttttgaaaatcatttgggctggatgtggtggctgatgcctataatcgcagcactttagtgtgatggagggtccaacttcattttttttttcatgtgactatctgatcatcccagacctatttgttgaaaagaatggtcttgttgacttttttgaaaatcatctgggctggatgtggtggctcatgccagttatcccagcactttgggaggccacagtgggaggattgcttgagcccagaagttgaagaccagcctgggcaacatggtgagattctatctctacaaaaaagaaaaaaaaaaagaaaaaaatagaaaagcacttaccatagatgtttaggcttgtttctgtactctcaattatattccattgatatgtatgtatgtatgtgtcttttgccagtaccacacagtcttgattactgttgctgtgtcgtaacatttgcaattggcaagtgagtcatcctatattttgttcgtgtttttcaagtttgttttggctattctcaaggtcttgcaattccatgtgaattttagaataatcttttcaatttcaacagtgaagtcatctgggatttttttttttttttttttgagatggaattttgctcttgttgcccaggctggagtgcaatggcacgatcttggctcactgcaacctctgcctcctgggttcaagcgattctcctgcctcagcttcccgagtagctgggattataggcatgtgccaccacgcctgactaattttgtatttttagaagagatagggtttctccatgttggtcaggctgatctcgagctcccgacctcaggtaatctgcgtgcctcagcctcccaaagtgctgggattacaggcatgaaccgccacccccagcctcatctgggattttgataaggattttgttgaatttatagatcaatttggagagcattgccagtaataagtcttttgatccatgaacatgggatagtttttcatttatgtaaacctttaatttcttttaacagtgttttgtagcttctagagtataagttttgcacttacttgaataaatttatttttgagtgtttttattctttttgatgttattgtaaattgaattattttcttaatctcatttttgggttgttcactgcaagtgtatagaaatataatagatttttgtatattggttttctatcctgcagccttgctgaacttgtttatcagttatcatagtgtcttagtagttcccttaggattttctaaagatcgtatcgcctgtaaatagagatctgttcttttttttggaggagtttgtgaagaactgatgttaatttatatttataagtttgaaagaatttcacagtgaaatcttctgggcctgggattttctttgtggatagtttcttggttgtcaattcagtctcttcccttgttatagctcattcaaattgtctctttcttcttgagtaaattttggtagttgatgttgtcctaggaacctgtccatttcatctaagttttctaatttgttggcacacatttgttcgtagtattcttttctaatccctcattagtaatgtcccctcttttatttctgattctagtaatttgagtcttacctcctttttgtcagtctagttaaaaggtttgttaacttggttgatcttttcaaagaactagcttttggttttatttatttttttccatttttctccttttgatttcattattttttgccataatctttattattttcttctttctggttgctaggaatgatatagctacaagccaaggagcacttagggttactgagaaccactggaagctggaagagacaagggaggattctttcctagagccttcacagggagcatggccctgtactcaccttgattgcaggtgtttagcctccagaactgggagaaaatacatttaagttgtgttaagccactcaatttgtggtagtttgttactgtaccctgaggaaactaatacaaacattttaattattttatttatttttttactgtatttatgtgagttactttttagtatctagggtttaacatgtgtgtcttaacttaccagaatatacttcatatttataatttaattctagttagataccaaaatgttattcctatgtagttctattgtcttcttccctttttgtggtatttttgtattatgtctattaatattacaaacccaaccatattattgttgtaattattatttttaaattttttaaaattttatttttaagttccctgttatattactttactatctgtagtaatttctttagcctagtaacagctttgttccaactctcttttgtgcagttatttgcaaatatattacaagtatatttctatatatgttataggttcaacaataggctttatatataatattttatgcaattgctttttaaatcatttcagagaagaaaggaaaaaatatgcattgttagtgtcatagttacagaataacctttactgctatgcttcaattttctgtgagaattcagattaccctctggggtcacttgttttcagcctgaagaacttcctgtggtgtttcttctaaggcaacaaattctctacttttgtttctctgggatgtctttatttcaccttcatttcctgccccccagcccttttttttgtggtaagatacatataaaatttaccattttaatcattaaacattttttgaaaagttttgtgctctcatgagccttggtcctgcacatctttctcctcctcagcagcaatctcgtttcctgcttaattattttttggttttgctttttgtttttgtttttgttttttcgagacagaatcttgctctgtcgcccaggctggaattcagtggcgcgatctcgactcactgcaatctctgcctcctgggttcaagcaattctcgtgtctcagtctcaccagtagctgggattataagtatatgccaccatgcctggctaatttttgtatttttagcagagacagggttttgccatgttggccaggctggtctcaaactcctggtctcaagtgatcgcctgcctcggcctcccaaagtgctggcattataggtgtgagccaccgtgcctggcctcctgcttaatcatttttaaattttttttattttttattttttgagacggagttttgctcttattgcccaggctagagtgcggtggcgcaatctcagctcactgcaacctccgccttctggtttcaagcaattctgctgcctcagcctcccaagtagctgggattacaggtgcccgccaccacacccagctaatttttttgtatttttagtagagacggggtttcaccatgttaatcatttttaagtatactgttcagtagtataaagtatatttgtattgttgtaccaccctcaccaccatctgtctccagaactctttttatcttgcaaaactgaaattctgtacccattcaacaataactccacgttactccctccctcagcccttggcaaccactgttttactttctatctctgaatttgactaccctaggtatttcatacaagtgaagtaatatggtatttgtccttttgtggctggcttatttcacttagcatagtgttctcaaggtttagccatgttgtagcatgtgtcagaatttcattcctttttaatactgaataaattccattgtgtatacatataccacattttatttatttgtcgatggacccttgggttgcttctaccttttggctattgtgaataatgctgctatgaacatggatgtacaaataactcttcaagaccctggtttcaatccttttggatgtatatttttgaaagacagctttgtcgtatataggaatctttattttttttctttgagcacttcaaatatgttatcattcattgtttctgatgagaggtcaactgtttctattattgtggttcttttataagtgatgttcttttgtaagtgaggttctcttataagttttcctctagctgctttcaatattttctctgtttttgacttacagcatttttaccatggtgtatctgtttgtggttctttttgtatttatcctacttggaattcattgagtttcttgattgtataggttattgctttaaaacaaaaatctaggaagttactggccatcatttgaatattttttcttcctctttctcatctgcttccggtactctcagtatgcatatgttaatgtgattaatggtgtgccacattttgctgagattctgtttatttttcttcattcttttttctttttatttttcatttgaataatgtctattgaagtatatttgtctcactaaatttttcttctgccagttcaaatatagtgttgaaccttctctagtgaattttaaattttagttattctacctttcaactccggaatttccattgtattatattttataatttctatgcctttattgatattctctatttggagtaatattgttatgatactttcctttccttttttaatcacgcttttctttaattctgtggacatatttataatggttactccaaagtctttttctgttaaatctgataactgtttgctctcacttgcagtttcccttgtctacttcccccgtgataccccatcctatcataaccacagaaagtatggttcatacttccttgtttcttttcatgcttcatatatatatgtgtgtctgtatatatgtatatatgtgtatgtgtatatacacacacgcgcgcacacacacacacacacatatatatatgtatattttttttttttttgaggtggagtctcactttgttgcccaggctggagttcagtggcgtgatctcggctcactgcaacctctgcctcctgggttcaagtgattccctgcctcagcctcccgagtagctgggattacaggcatccaccaccatgcctggctaatttttgtatttttagtagagacggggttttgccatattggccaggctggtctcgaactcctgacctagggtgatctgcccgcctcagcatcccaaagtgctgggattacagacataagctaccatgtccggcctgtatatatatattttttggttggaaactggacttttcagatactgtattgtaggaactctgggtattggcttcccacttctggagcctcttgttcttatttgtttagtgactgcatagattattttaatgaagttgatttccccctgtcttggttcatttgtcttgctataaaggaatacctgaggctggataatttataaagaaaaaaggtttattgggctcatggttttgtaggctgtacaagaagcatggcatcactatctgcttctggcgagggcttcaggctgcttccactcattgcataaagggaaggggaaccagtgagatcacatggtgagagaggaagcgagagatgggggaaagtgccaggctgtttttaataaccagttgttgtgggaactaagagtaagaactcactcattcctgcaagaatggcaccaaaccattcaggagggatatgccacccccatgactcagacaccttccaataaggccccacctccagtactggggaacaaatttcaacatgagactcggtggggccaaacaaaccatatccaaaccattaacaccctaacagggttaaaccccttatgttgctcctcaaggaggtacagctttgggtgtgcttattgtcagcctcaaatgacagtgatattgatagggctctcttcctaaacagttagcaaatttaacagctgttgaactccactaattgttagctggttgctctatttaacaatgccatggagcataaaaattgctctaaatactaatacaattaaattctggctcctttaaatagtttctaaagtaagcgtttgatattcttttttttttttttcttttgagacggagtctcgctctgtcacccaaggctggagtgcagtggcacaatctcggctcactgcaacttccacctcccaggttcaagtgattctcctgcctcagcctcctcagtagctgggattacaggcatgcaccatgacacccggctaattttttatatttttggtagagacggggtttcaccatgttggccaggctggtctcgaactcctgaccgtgtgatccacctgccccggcctcccaaagtgctgggattacaggtgtgagccactgcgtcaggtctttcccccaattttttactaaaaaaatgtcaaacctacagaaaagttgaaagaataatacagtgaattcccatatacctttcatctagttgaccaaagtgctggaattacaggcatgagccaccacgactggccttatagatcttagtttggcatcaagtgtaagaattctttacctcgccttacatcccaaagattttctatttttcctttttttttttttttttgagttggagttttgctcttgttgcccaggctggagtgcaatggtgtgatcttggctcaccgcaacctctgccccccgggttcaagcgattctcatgcctcagcctcccaagtagctgggattacaggcatgtgccaccacgtccagctaattttgtatttttagtagagatggggcttctccatgttgatccggctggtctcaaactcctgaccttaggtgatccacctgccttggcctcccaaagtgctgggattacgagcgtgagccaccgtgcgtggcctttttctaaatgttttatagatgtatatcttatgtttagtccttgagtcattttgagttaatttttctgtagggtgtgaggttcaggttcatctttttgcctatagatgtgcaatgactctacaccctttaatgagagacatatcttcccccgttgaagtgttttaacacctttgtcagaaatcatttgggcatatttgtgtgtgcttctttcttagttctctatttggttgcattgatctatagctgtccctctgtcaatatcacagtcttgattactgtagctatgtaagtcttgaaactggatagactgattcttcccactttatttttctttttcaaatttgttttagctactctagttcctttgcatatttccgtatacatttttgtatgatcttgtctatatctatgtaaaatttttctgggattttggtagtaataatgttatcctgtgtaataatttggataaaattggcatctttactatattaagttttccaacctataagcatggtatatttcacgctatttaagtcttctttgatttcttttatcagcgttttgtagttttcagcacacaagtcctgcacattttgttagatttatatgtaagtatttcatttttttcaggcaattaaaaacagtatttattatgtttttaattttagtacccatgtgcttattgctagtacatagagatacaatttttttttttttaaatagagatgtggtctcattatgctgctcaggctggagcacagcagctattcacaggcacaatcattgtgcattacagcctcaaactactgacctaaaacaatcctcctttgtccagctcaattgatttttgtatgttcatcatatatcctgaatcctaaagacttactgaattcacttagtagttttagtgtttttaaaattaggttattttgctttttttttttgagacggagtctcgttctctcacccaggctggagtgcggtggctcaacactgcaacctctgcctccgggttcaagtgattctcctgcctcagcctcctgagtagctgagactacacatgcctggctaatttatatattttttagtagagatggggtttcaccatgttggtcaggctggtctcaaactcctgaccttgtgatctgcctgcctcggcctcccaaagtggtgggattacaggcatgagccactgcgcttggctgctttgcatttaagaaaagtcatgctttattttattttttttgagatggagtctcactctgtcaccaggctggaatgcagtggcacccagctcactgcaacctctgcctcccttgttcaagcaattctcgtgcctcagcctcccaagtagctgggtctacaggtgcacgccaccacatcctgctaatttttgtattattagtggagacgggatttcactatgttgaccattctggtctcaaactcccgacctcaagttttctgctcgcctcagcctcctaaaatgctgggattacaggtatgagccactgtgcctggccaaaatcatgtgtttttaaactgacagataaaattgtgtgtatttatcatgtacaacatgatgttttggagtaatatacgttgtgctaattaacgtatgcattacttcacatagttatcatttttgtggtgagaacgcttaacacccactcttttagtattttcaagaatacaatatattaagtatagttaccatgttgtgcaataggtatcttgaacttactcctcctaactgaaatttggtatcctttgaccagcgtgtctccactgcccccctacccctagttgctttacattttctatgagacaatcatgtcatctgcaaacaggaacagttttatttcttctttgccaatctgcaggtctttcatttccctttcttatcgttttgcacaagttagaacttcagggctatgttaaataagagcaatgagagtgaacatccttgctttgttcctgatcgtaggggaaagcatttagtttttcaccattaagtataggttagctgtaagcttttgtagtcttttgtaagctttatcaagtcaaggaatttcccctttattcttatttttcttattagagtatcatgaatggatattggattttggcaaatgcttttttctgcattgattgatgtgattatgtagttttcctctttagtacgttcatatagtgggttaccttgttttcaaatgttgaaccagacttgcgtttctggaataagtcccacttgatcatggtgtataattatttttatatattgcttctacttgctaatattttgttaaggagtttaaggagttttgtgtctatactcatgaaggatattggtctgcagtttatttttgtttttttttcctttttattttccccaccaccctgcctggctaatttttgtattttagtagagacagggttttaccatgttggccaggctagtctcaaactcctgacctcaggtgatccaccagcgtcagcctcccaaagtgctgagattacaggtgtgagccactgcacctggcccagttttctttttttatactgcccttgtccagtgcttcttttttttttttttctgactgttcctgcagagcagagctacccataggcagtgtgtcaagagtagctgtccttatacagttctagtatcagagtaacacccacttcataaaatgaactgggagatgttcccttctcttcagttttctcaaagatgctatgtagagttggtggtaattcttcattaaacatttggtagaattcttcagtgaaaccatctgggcccagatatttgcttcttgagagttaaaaacattttttaaatccttattcttcaaacaaagttctatttttctgaagatatttttcacagtacatacatctctttagctgcaaaataatttgtcgtttttatttgttaaggaagggtataattaccttatctaatatttataaaatattaagtttaatgtttctgttttaagagtgttaaaattacaaattcaattttctcagtagttatcaggctatcccaattatctatttcatattgggtgagttgtggtaatttgtgttttttcagtaattagtccatttcatctacattgtcaaatttataatgtgtagagttgtttctaattatgctttcattctaataactggtaatccgtgtcttctttcttttttgtttgttagccttgctagaggtttgtcaattttattaatctttcgaagaatcagtactttgtttcactgattttctttattgtgtttctgttttcaattttactgatttatttttatattttctttcttttgcttgctttgggtttattttgctcttcatcttctgtgttcttgagatgggagtggagactattgatttgaaactttttctcttttctaatgtaaacatttagtgttataaatttccctctcagcattgctttaactatgtcccacaaattttgatattcttttttttttttttttttttgaggcagtctctgtcgcccaggctggcgtgcagtggcacaatcttggctcactgcaacctctgctgcctgtgttcaagcgattctcctacctcagcctcccaagtagctgggaccacaggctcccgccactgcgcttggctactttttgtagttttttagttgagacggggtttcaccatcttggccaggctggtctcgaactcctgatcttgtgatccaccagcctcggcctcccaaagtgctgggatcacaggcgtgagccaccgcacccagccatattcatttttagtcagtttatttcccttaagaaatttttaaaaatacattaaacaataaaaatgaatatcagaaatgaatatctttgacccacggatgattttagaaatgtgctgtccagttttcaagtatttggaggcttttctcgttatcctccagttacctctttctagtttgattccagtagagcacactctgtatgacttctattctttgaaatgtgttaagtttttaaaaagcgttagatataatccacataccatatgtttcacccacttaaaacgtacaattcaatggccttttttatatttgtagagttgcgccaacatcaccacaatcaattttggaacattttcattatcccaaaaagaaatcctacactctttaactgtcaccttctccctccccatgcagctcttccactgtccatccaagccttcggcaatcactagtgagctttgttttatggcccagggtagggtctaaggatatgttcagtgaatacttgaaaagaatgtttattttgctattgttgggtagagtgttccgtaaatgtctattagatcctgttgttcagtggtgttaagttcttctcaactccatgctgatttttttgtctagttgttctatcagttgttaagagagggtgttgaatctccaagcagaatgattgatttgcctgcttttctttcaggatcttttcttgatccttttattcctgtctcttgaaattttcttttctctgaagtctattttatgttattaatatagccactcctttcttttgattaatgttttcatgatatattttattcttttaatttcaaccaacatatgttggtatatttaaagcaggtttcttttttgtttttcaactgaggtggagtctcactctgtcgttcaggctggagtggcgcaatcttggcccactgctacctctgctgcccgggttcaagcagttcttgtgtcgcagcctcctgagtagttgggactacaggcgtgtgccaccatgcctggctaatttttttgtatttttagtagagatggggtattaccatgttgtccaggctggtctggaactcctgacctcaggtgatccacccgccttggcctcccgaagtgctgggattacaagtgtgagtcactgcactcagcccaaagcaggtttcttatagctatgtttttaaattaactctgctatctctgtcttttaattgatataattagatcatttacatttatgtaattattgataagttagggcttaagtctaccattttatttatgtttttaaaaaatttagtttgtcctcctctttttttctctttttgtcttgtcttcctgtagagtatttgaatattttttagaattccatttcaatttatctaaattgtttttggttattatctctttgtatagtgttgttagtggttgctgtattacattatatgtatatatatatatacacacacatatacacacatatatttatatatacttacgtgtgtgtgtgtatgtaacttttcacagtgttgtcattttaccacttcaatgaggtatagaaacctatactttccccatttataattctctgcatacatttagtagaagcacttcagacagggttataatttttgcttcaaccatcaatataatttagaagtcttaagaggagatagaaattttattgtaattacatgtatttttgcttactatgttatttctttcttcttgatgtttctggattccttctttcatcattttttggtctgttgcatgatcttccttttgccattcctttaggggagatctgctggcaacatattctcttattttgctttatctgagactgtcttgatttcccattgattcttgaaggatatttttactgaatctagaattttgtgttgacacttcttttctttcagcacttgaaaaccattgtgtcatttccttctggcttccttaatttctgtaagaaatctgttacttgaattgtttttcccttatacatgaagtgttgtttcactcactgctttcaagacgttttctcttttcgtcttttcagaagtttgactatgatgtattttggtgtggattttattgggctttttatttggggttcagcatttcgaatctataggtttatgtctcttgccaaatttgggaagttttcagctattattttttgaatacgtttccagctgtgccatctttgtctctttcctggaccctgatgacaagtgttagatcttttattttagtctcagaggtctttgagactttctccctcactccttccctccctccttcccttccttccttcctttctctttttccatcattcctcctgctgctcctcttttttcttctttattttttggccagtctattttctttctgttcttcatattgggtaatttctattattttctgttgaagttcactgattattttgtctgccccctccattctatgttgtctttccattcaatttggttactgtatttttcaattctaaaatttccattaaaatatgtatctatttttttgagatggagttttgctcttgttgcccaggctggagtgcaatgtgcaatggcgggatctcggctcaccgcaacctccacctcctgagttcaagcgattctcctgcctcggcctcctgagtagctaggattacaggcatgtgccaccatgactggctaattttgtatttttagtagagacggggtttctccatgttggtcaggctggtctcaaactcctgacctcaggtgatccgcctgcctcagcctcccaaagtgcagggattacaggctgtgagccactgcacctggccaaaatatatatcttttatttctttgccaagatttttttttcatttgtttcaagcacgtttgtagttgtttgttgaggctttttttttttttttttttttttttgggacgaagtcttgctctgttgcccaggctggagtgcggtggtgcgatctcggctcactgctcctcttcccaggttcatgccattctcctgcctcaggctcccgagtagctgggactacaggtgcccaccaccatgccttgctatttttttttgtatttttagtagagacggggtttcaccgtgttagccaggatggtctcgatctcctgatcttgtgatccacctgcctcggcctcccaaagtgctggggttacaggcgtgagccaccgcgcccagcctgttgaggcttatgatatgtgctttaacatcctttcaggtagttctaatatctgtgctctcttagtgctagtgtctgtcaattgtcttttctctctttcagtttgggatcttcctgactcttggtataaatgatcctcaatgaaaacttcaacgatttgggtattacgttatcagactctagaccttatttaaacctgttttgaacaccattgtagtagaagaagggggacatcagcttgttacttctagatgggggtaaatatccaggctttccgctctgcttccattgacacccaatggggtgggggacccctgttgctgctgggtggttgtgggtattctggttccctacttggcctccctgatacctccctggctaggaggggtaggagtgcctactgcttgccacagtgctttcactgtcaccatgggggaagagggaggaaaggtggcctcattatctctgggaaaaggttaagtcactgaatctccactaggcctcctctgacatgaccccagcagggagggcctcatcactcctgggtgggagtggaagtccaggttcccctgacactgctggcgggtgagggatgggctccttactactgccatgcagggataaaagtcgcagtccttactcagccttggtgggggtgttgggtaccttggtacgtcctcacaagactggaagtctaggctccctgctcagttattgctggtaaatgggcagttactgtctaaatgtgttccatctcattagactgtctccttcctggtcctttggctagagagggcaggcttttcttggggcttttcaatctgtgccccttggtgttttgaagttgcctgctgcttcagctccaagtctgagataatgaagcaaaaagaagacccagtgaacccatcactgggttgttctgtgggcctcaaggcacctggatagtctgcctcctcttccccttccagaaccttcttatatttgttttatatctagtgttgagggtttttattaccacttactgggaagaacagggaaaagtatgtctgctctgtccctggagctcaagtccacaacttgcttttcgtttgtttttaaataattagttttgtttttaaatgaaactgagttttctttggagaggccaagcaagtttctttggagaggccaagcaagttgtctggtggagcgtctcatggtcagaagctgtccagttcttcccttgtgattagcttcaaacagttttggcgagaagctgtgtgggcgatgctgtgtagctcccacatcacaaggaggcacatagtgttgtggggcctggctgggggtcacaggaagcttgatcacatcttccttcctgtatctaataaattatctgtggtgtgaaactctgagatcatgtgagcatcctcttcccaagcagccttttactcagtggttttagcatgtctaggtgaatatattaaggtttacaaaatgataatttttctaattctctcatttcctttacatttattagctggtattcttccatgaagaagagctttatccaaagccacatccttttgttctctttttagtaccaatatgtattttaattcatgttttataattcattactgtcatgtttttcttgaaattgttccacgcggggcaaagtgagctccttctggttcactcttaggtccatttaacatgactctgttaatctttgggcagttccttgatttctgggcaacatgggatgtcccagactcaccattttcatttcatagtccacacctagaatcagctatttccccaaggagccctgcttccttttagtaaggaatggtatttagaaatgcaaataaatttccaagggagaagagttttctaagggaagataaagtattgaattatagtagttactcgtagtcacaactgctactgtattcttggtgacttaggccctcgtttgaagttagggaggtagagcttcatgtgacagtgatttgtgtgcctgtgtctcctctatctggctgactttcttgggagccaggagagtatcttttcaatttttatattcacagtatttagcactgtttctggaacagaggaggatttaataactatttggacttaaattgtgctaaacagactcctaagctgtgcatcatagaatccaagaatttttctaatgttctgcctgtgtggagaagagtaaggatcttctccacacagtggagaacatttctcacagtggaaatgttcataggccctgggcagattattcagtgtttcagaacttgtttctcttgctgaatgggaagcattttattggcttcagcatgctaaaaaaaaggctataacaagatctgaggctgttcttacgaggtagtggtaaagtatgggtatgggattcagtttgaacatttagagaaggtgactttgtaatctgtatatagctcaccctggaggtgaatggtactggttttcagcctctacttgggagatgtgtgtttcttcttttgctgactctgctactatatagttttatgacctttaagtcagtcagttgctcaatttcttttccttattttcatctggaaaagagcgtgatggtgttttgaattaagatataataagaaaaacatataaaacccttggatatgtagcaataaaatgaaagaagatgtattataagcacagaacttggccattatgagtagcaacaaaggaagcctagtgtcaggtcctagggtttgtttttatttgaaggagctgtatgtggcattttaataagggttccaaatgaaagggtagtttcaggctgagtctagctttgagactataatgataatgggactgtaaagttatattaaagtgggtttaggcagaaggcacatgaaaagtacatttatttataaccgcattttgagtgaagggatagaacctaaaaggaaagactaaaatattcaacatggtatttatcaagtaaagggtgtgctcacgcacatgcgtgcatgtgtgctgtgtgtgtttatgatgaataagaactcttttattccatcaccatttgtttaaacatgaagtttaaagaaatgctttatttcctgaattttctttttccaaaaagtaattcttgcttggggtaaaaattacaagcagtatagatatacaacttagtaaaacatctcaatattctgctgatagttttgtttctgttctttcagatgttttctgtgcacacactagatttttttttccagaaattagctcatactgactatcataagcccatcctgctgctgcttgagtttgttttcacgtaacacacagctttttatgtccatctgtggacatccatatcactctttttgatggttgaatgatgggtacataccctcatgtacccagtatcctattgagacatatggattatttcttgttttttgctattataaacaatgctgcagtaaataccattttgtgtgtgtatctgctgtctcatgtactttggattgatatctaagagtggaattactgaaacaaaagttgtggatatttatgttttgccagttgttctaaagagttggttaatttgcagggctgaggattcctcatctcagatgacataaggttcttgttatactctctaagtgccctgagtttctctctcacatatggtggctgtaatcagtgggcattacaggtgcctttgagatggtgtgacccttccagggacatctgtatcccacagaatgtctaagttggtacatcctagctctcagcacgttcctcctactgagcccagacttggcagggttggccaggtgtgtgcttatagtttgtggtttgagactgtggcagtttttcctgctttatctgagatgatgcttttctaccctgtttatcagtagtgttttttgggctgggggaggtcacaggtgaggtgatgcaaaataactcctactcttgttttcaactggaaactaatttatatcttattttgttgtatctggcttttcctccccctctgttaattggaagatatgcttatctttctcagtttatcgacttgagaaagaaatcttttggttatacctttctaaaaaaaaaaaaaaccattagcatagtaatattacttcacacttcctgtaccttaatctccagtttttgtgacgctttgagaattcttttttaaaaatttaagttttaatttttttagagacagtttcttgccgtgttgcctaggctgagtcttgaactctggtctcaagtgatccttccacctcagcctcctgagtagctgggattgcagatttgagccacagtgcctggcagagtttttgttattattatcaaattaatattatttttacattattaattttttctttctaggcttcttaaaattatatctaattttctatccatagttaacccagaccatgagatttaattctatttagatttaattctgtgcctaactggaactggtactactgctagttcattcattgataacattgaatactctgaactatgccctgttctatgtcctagggataaagaaatgaataaatagacagaaatccctgcccctctggagtttatgtactagagggggtggcaaacaatgtaataaatgagtaagtcttagaatacgttagaagagaacaagtgctaaattgtaagaataaaagtggaatagggtgagtgaggtccatggggtcaaggggagtatgtagaatttaaatagggtagtcagggagggccccattgagatgctgacatttgagcaatgacctagagtaggtaagggagttaactcactgcaggtggaggaggcggccagagccaagactcaaggagtcgccttcctgatgtacaggaggggcagtgaggaggccagggctgctagggtatgcaggagacacgtcacaaggatccggagggcacgtggggtggggggtgggaagggctttgtagaccagtgcgcactggagggctctgacttgggtgttgatgtggtcactctgctatgctgagagcagactccaggggacaagactgggaggagggaaaggtgctgactattgcaggaaagccgggcgagagatgttggtagatgggaccagactgatttgaagctatgaagttcccattaatgagcacattaagtacatttaactttcagtgggctggattaggactacatttttcttaaggattcttgagtatgagaatgcttgtgttctttcatgttgtaaatgcttgtgttctttcatgtctttcatggcttttgcagcctttaaataatgcgtgacattctaacttggtaaagatgtgttgggtcactttctctcccttctggctcagtaggcagcattcttttgtcttcagactccagtgttctggagaagactgcagatggtctgcctttttccgcattatgggtcacccacttctttctctgtgttggtagaatcaccagccttgctagatgtgtcttgtgctggttggactctactgatttttcttggcatatgctaaaccctttcaagctatagattcagttactcaatttcaggaaagttttccggtgttatatcttaaattttcttttcctgtgccatttgttttgttctgttcagaattagcagttgtgtgtctgttggatctttatctctcgtatctaacttttttttttgagatggagtctcactctgtcacccaggctggagtgcagtggcgtgatctcggctcactgcaagctccgtctcccaggttcatgccattctcctgcctcagtctcccgagtagttgggactacaggtgcctgccaccacgcctggctaattttttgtatttttagtagagatggggtttcaccgtgttagccaggatggtctcgatctcctgaccctgtggtccccccgcctcagcctctaacatctttttaatcacttttatggatttcctatattccatttccccaaatgaatgtccgctttcactgacttcttcagcaattccacttcacttcttacccttcttcacgtaatgttcatcagataatggtgttagtgcttttctccattggtgtccttgactcatccgttaccttccttcagtaaggagcagggcccacagggaaggatattccttgctttaacctctcactaagctgagataaatttgaatacggctcaagatctagagaaatgagtctttttttttttttttgagacagagtcttgctctgtcacccaggctggagtgcagtggcgtgatctcggctcactgcaagctccgcttcctgggttcacgccattctcctgcctcagcttcccaagtagctgggactacaggcacctgccaccacgcccggctaattttttgtatttttagtagagactgggtttcactgtgttagccagtatggtctcaatctcctgacctcgtgatctgtccgcctcggcctcccaaagtgctgggattacaggtgtgagccactgcgcccagccgagaagtgagtcttgattcttgtcatcttccctcgattttgttcagcaaattcctgtctcagaaatagcctttgtgtttgttgctcagggttgaggcccttctctactttcattataggttgaatttccttctctgttttgactttaatagaaggggagagtagatattttttcttttgtaagaattcccagggccaggcgcggtggctcacgcctgtaatcccagcactttggagcctgaggtgggtggattgcttgagcctaggagtttgacattagcctgggcaacatagtgagaccctgtatatacaaaaattagcatgatggcacgtgcctgtagtcccagctactcaggaggctgaggtgggaggattgcttgaacccaggaggtcgaggctgcagtcagctgagatcataccatggcattccagcctggatgacagagtgagaccctgtctcagaaaagaaaaaaaaaaattcccagacatatcgcttaaaaattatcttttgtgaaaaataatatattacagtatataaaattcaacatgtttaacggggaaggagggaaaagaagattatcttctgcccctgtcccttagctcccagttcccagccccaggaagcacaaccatatagaacacattcctagagtggaattgctttgtcaaaggatatatgcacttgtacatttgatagacgctgccagattgctttccatagaagccatcagtatatatatgctatcagcaaaaaatgagagtgccagtctcctcacattctcaccaacatgatgatgtttgaagtttttcaaatttttgccattctaataggtaaaatagatttgaaagttttattttgcatttcctgttaatacaggtggttgaggagccaggtgcggtggggcacacctgtagtcctggtactatcatttgagcccaggagtttgagcctaacctgggcaacatcgtgagaccctgtctctcaaaaaataaataagtaaaagtcagtctgagcatcttatgtgccgaagagccatttgtattctctgtgaactacctgttcattacctgtcacatttttattttgggttagtggtggtttttttgttgggtttatataggtactctttatgtgtaggaaaattaactctgtctggatatgagtcaagttttgttttcccagttcattcagctatgattatttagctgtgtttgtgctatgttttaggcatgtagaaagatttggtttgtatgtaggtgattttctcttttataacttcagggtttttatattataggcattccccatcctaagagtccgaggattctacggtgttttcttctgctaattatactattttcatttttttcttttctttctttatttttatttatttattaatttttttgagttgaagttttgctcttgttgcccaggctggagtgcaatatctcagctcaccgcaacctgtgcctcccagattaaagctattctcctgcctcagcctcccaagtagctgggattacaggcatgtgccaccatgcctggctaattttgtatttttagtagagatggggtttctccatgttgctcaggctggtctcgaactcccgacctcaggtgatctgcccaccttggcctcccaaagtgctgggattacaggtgtgagccaccgcccctggccaatttttttcttttaaatatttggtgctcctcaccaacatggcacatgtatacctatgtaataaacctgcatgttgtgcacacgtaccctagaacttaaaactataattaaaataaataaatatttggtgctccttcagttactcctggtgttaggagtaaggtagggtgcccaactgtgtttttcctgatgcctatcctgctgtctgaacaccatttgttggttcctttggaatactagatttatcgtatattaaattcctgtatatgtttgaacctaattcttggtctagtccatgtctgtttgtctattcatgtaccaatatcaaaccttttaaaatttaggcttaaaatattttttaaaatgcaaattcaataaaatcattttggagagaagtcttattggaatatttcagtagttccttcacagtaagatgttgtagatcattcttctgagcacaatctgctattcattgttagggcatgtgtttagttacctactttgaattgattttgctgaaagaagtaaggattcttgggtggtctttctatattctcctaccctggctccttggtaatgtggaaaatgaattttcaggtaaaattgtcagaggacagtaggatggtttttgttctggagtatattaacatgaactggcccaacttaggctcacatttgataacttcatgttagtaagcatcctcctttggttaaataaactggctgtggatattctccagggaaaaagttactagtaactcttagaaaactaatgcatacatgagctggtaaagaggaacttcttaaagcacaattttagagttatagaagcatatatttgttgttatgatcttgcaagtttgctaactgctttactgaaaatagcgtgcatggaaaaacatagcatagtaggtcccaaataagcacttggttctttctttctttctttctttttctttctttctttctttctttctttctttctttctttctttctttctttctttctttctttctttctttccttctttccttctttccttctttccttctttccttctttctttccttctccttcagacagagtcttgctttgttactcaggctggagtgcagtggtgcaatcttggcccactgcaacctctgcctcctgggttcaagcaattctcctgactcagcctcctgagtagctggggttacagggacctgccaccatgcctggataatttctgtatttttagtagagacaggtttcaccatgttggccaggctggtcttgaactcttgacctcaagtgatctgcctgcctcggcctcccagagtgctaggattacaggtgtgagccactgtgcccagctagcacttggttatttctttaaaaaatcaaatttaaattctgtcctgaatttgttatatgctttcttttaaaatgtatgtttaggtaaacatctgttttagggctttttcttcctttgaatttttttcctttatttgttcattcaacaaatattaattacttgctctgtgctagacagcgttttaggtactgatattcagcagacaaggatcttgcttttattgagtttataatctagtgggggagatcagcaataaataagttgtcaggatgtgattagttttatggagaaaatcaagtagggtggggtgaaagtgactcactttgggggcagcatccagtagcattagttaccttttattagaaaggcagcatgggaaaatagaagcatggacttcagagtttgatacgttcctgtacaaatctcagattttctacatgcaggttgtgtggccctgagcaaattacctaacctctctgacccccatttccccaactgtccaaaggggagagaagaatacctgactcatagtgggttattaaggattaaatgtgacaacttcaacaaaaaaaccctagaagaatgtttgacctgtaatagtcactttataaatagcagctaaaatattatcacttcatcactttattcattaaaagtttttaagaagtttctccattatttcattagtttcaatatcatgtgcctagtaagatggtaggttttaacaaaagcacccttaaatagccatttgtgccaaatgtcaccatagtgactgctaaaatgggggaaccgcaggtattactgtattcatttccatgaattgtcatagtttaatgttcatctacagttggtcatgttttgttgaggtcctaacagaaaaggaactacatttgtattgaacattgtattagaacaaattttaatacctctgaaaggtcatacatcaaagaatctagaccaaaaaccagagttctagctcagaaacaccagcactaccactgttttatctgtcccacattgaggaatatgacagactctggttcaaagataccttaacgccttatccatactactagaggcccaggctgagattctcctagaccacaggctgggagcagtgacatctccaagataccaagtctgtcagggtcactgatggagatttccatagaggaggttctcaggcctaactgaaggcatcacttcttagatacgtggcccaatcaaacactatccaaggaaggagcatggactctagagaggtttgggaacagggtagcagatatgccagaatgctgaaacctggaacaggccaggaagacaaaacagcagtctgcatgtagcaaaaagagaaggtaggaaggtacaggtaacaacaaaatggatttgaggtgagaatctcaatgtgaggtcacatctatattcctaacacacacagtttgttacctatgcgtttgccctagagacaggaccacactaaatagcacccattctttcttattttccttatccctcaaacaaagaagtgtccctctcttggccccaagtcaatgggtaagggattctgccaagacctttgtcaactatcccctatcatttatgttttttacctctccctgtctactgatttattctccctctacctcaaaacatgcttatatggttcctttctttaaaaaagaattccaccgaaatttcctactctgacctctaactcaatagttaaagttcctttcatggctcacttttcagggggaatctgactccacttcttttacctttcaattcctccttaattctgtgatcttcctctattcttgctaaagtcatgaccatctatgggtatgttcattgcctgttggacatttgaatgtctcaggcatttcaagttcagcattaattgaaccccctatccacttccacagtgtgatgatttttaaatatatccacaaattctttgacacttcttatttcaagaggtggagcttagttccctttctaactaatggaataaggcagaagtgagagtgttaggagtaggtccatagtgttaggagtaggagtaggaagaacactgtggcttcctccttgctctctctctcagatcactcatgctgagagaagccaactgccagatggggaggatgttccagcaatgctatagagaggctcacttggcaatgaattgagatctcctgccaacaaccagcactgccttgtcaggcaggtgagtgaactccttggaagtggaccctccggccccagttgagccttcagatgatgcaaccccagctgacatcttgattgcaacctcttgagaaactctgagccagaaccagccagctaagcctatcttagattcctggcccacagaaactgggagataagcctttgtgttttaagctgctaaatggttgtcagtgattggctacacaccagtatataaccaatacacacggcaaaccttccgtattcccagtcgtagggaaagcaaggaaacaactccttcctctccaagatacaactggtgatcaagtcctgttattttcatctaggtatctgttgattcagcctgttctgatttttctagtcactctgtcagtttattatttatcatctagactgtttcagttgcctcttaacaagtttcttgcctccagcttcactctcttttaatctattccccatactgccataaaaaatcattctaaaatgtgaatttgagcatctttcttctttgattgaattgtccccattgactagagttaatcaagcccagtcatcttaagcaatgcaggcaaagctgtttgaggtttcatcccaccatgctttccagctcctgtctctcctgcagcagggtgttcagccatcaaaaatagccggtgggtcccagaatctcccacggcttttcttctttctgtgatttggtgtgtgcagttctctctagttttggaaggctttcaccaactgtttgacgctttctctattttctgaaagttaggcattcctcctttcttctgcagtccccaggggatacctgtgtaattgctgtgatcacatcactgtcattgtttgtctctcaatgtctgtttttcagttagaccaagaatcccactagatgagggtcgatgctctgttcatctcttttttgttgttgttcttgcgtatctgatcttttaaaatgtttgatattctttttctttttttggggggggtggtgtcttgctctgtcatctgggctggagtacagtggtgcaatcatggctcactgcagccttgacctcctgggctcaagcaagcctcccacctcagcctccctaggagtgcacctccacagctggctaatttttgtattttctgtagagacagggtttcaccatgttacccaggctagtctcgaactcctgggcttgatattctttttttattttactgtggtaagaacacttaaccacatttgtggatctactacatttgttaatctacccttaacaaatttttaagtgtacaatacattattgttgactctaggtacagtgttgtacagctgatcttgagagcttattcatcttacttaactgcaacgttatgttcgttgattagtaactcctcgtttcccgccctgcagctccaggtaacctccattgtactctttgattctatgaatttgtctatttttggtatctcatataagtggagtcgtgcagtatttgtctttctatgactgccttatttcattagcaaaatgtcctcaagattcatccatgctgttgcatgttatagaatttccttttttttttttagaggctgaatagtactccatggtatgtatataccacatattgtctaccccttcatccactgatgggcatttagttgtttccacatcttggttttactctttgaggaacctgcatactcttttccacagcagctgctccattttacattctcataaacagtgcacaaaagttccagtttctctacatcctcaccaatacttgctgtcttttgattttttggtaatagtcatcctgacaatgtgcgttctgttcattttaagtctctagcaactaatgggatatttgaacagggtgtctgaaacttttagtctagcagatagggaatttcacattagcagagtcagaatataaaaatgtaactttacctctctatacatgatcataacttcactctctagccattgtttttcactaaaggcagtgaagagtctttggggatgagggttctggccccgtcactgatgctttcattggccatgaaggctttgctggttgttggtgccatccatttctctgtgttcccttttctctttatgttagtcccactgggccccctccgttctgactgtgagagttctccaggcttgcaggcttgtgctcagctgtttcagtgcctctctggagcatgcaccttgggaagtgctatgtgggtctcagacccaccctcctggtgcaggggcctgcttagggctgagcctctttaggaggactgcactctgggaagaaccaatgatgtgtctgggatttctgttagctagatctctcataaattccaagtcttagtttgggatggaaagaggtagaggatctggacttttcagagacttagtagcatctttaaaagaaaaatacttagttcttccagtggaaagctgtgggttccaagagatatctgctgtgcatttatgggcctattttagagcagaataccaaaatattcaccataattttaaaaataaatattaaataattaaaaaattggtacagcctgccaggagctcagtgtgcaatggtgacatccagcctgtgaggccacctggtgcggcttgggaacccgcagaagcctgcactgaagcccagcaaacccctcatcctagctaaccgcagcaaggactggcgtccggagaagggcgaggccgcttgtatcatggagtgtcagcttgctggaagccgaatgaattccgcgatgatatgtgcagaaaagagatccagggctttttcgattgtgcttcaagggattaggaagcctaaaaaatgagatcaatacaggagaccctgggagagtctgggagtttacctcccaataaatagagtaagttgtcatagaggtttcctaagacacctcacctaagcttaaaatggaaaagcattttcaatgatttctggactatagcttctgacaattatgcagaggcattttatagatgtttgcattgctgtgacctctttgaaggataagatgaggaaaaacactttttctaacctttggaatcaatagtatgggtagaagttatgttttatcttgaaataaaatcctctgaagagaaaaaaataattaaaaaattaattatacttgttttatatttataggagagatcttattgttggtgatctttgatagtatctatagcccaggacaaatttccagagcccttccatttctttccttattctgtttccattgaaatagaaagccgaaaccagaattagaggtcatcaggaatgatgatgagtgtttttgctctaactgatcaatctggatatgcattcagattaaatatggatgtagagattctagtgaaatttttttactgaaggccactttcagcattctttcagctgctgagttaacaagcatatcaaactaaaaaacagaaaggttggccgggtgcggtggctcatgcctgtaatcccagcactttgggaggccgaggcaggtggatcacgaggtcaggagatcaagaccatcctggctaacacggtgaaaccccatctctactaaaaatgcaaaaaagtagccgggcgtggtggcgggcgcctatagtcccagctactcgggaggctgaggcaggagaatggcgtgaacccgggaggcagagcttgcagtgagccaagatcacgccactgcactccagcctgggcaacagagtgagactccatctcaaaacaaacaaacaacaacaacaacagcaaaaaacaggaaggttaagtgttttttgtttgtttttgtttttgagacagggtctctctctgtcactcaggctgtggcgcagcatgaccacggctcactgcagtcttgatctcctgggctcaagcagtcctcctacttcagcttccagagtagctgggattacaagcatctgccaccatgcctggttaatttttttttttttttgtagagacagagttttgctatgttgctcaggctggtcttgagctcctggcctcaagcaatccacctgccttggcctcccaaagtgctgagattacagatgtgagccaccacacccagtccaagtgtttctatttagttgataatggtgagtagattcctaatccactctttgattgcatttgattctggaaaatgtttctttatatcattttgcagcatttcagtgtagtttttaaatatgccaatcatgtatcaaaaaatatatttctttaatttgtgaagaaaactgtcaactctcggggaagtcaaactcgtggagatttagctgcctacattgcagtttggtcatatcatcaaggtatcataacagcattaaaaaatcatggtattttggttaagattcaggctgttccagataatgattactgaaatatactacttgagtgaatcacctgagatcacagaaatggtctttatcagccttatcaaagtcatgaagaaacagttttttcctcattttaaatattcttcattttaaatatccttgcgagcacctttctccttagtatcacatgtatttcagtatggaaaagcagaccctgggactcactgtccatactgcatgttgaaaagcctgattgtccatgactgtagtgcgacttaaaatgtttatccagctgggtacagtggctcatgcttgtaatcccagcactttgggaggccaaggaaggaggatcacttgagtccaggagtttgagggaggatcacttgagcccagggtttgagaccagtctgggcaacatggtgagacccccatctctataaaaaatttaaaaattagctgggcatggtggtgcgtgcctgtagtcccagctactcaggaagtttaggtgggaggatcgctggggcctgggtgattgaggctacagtgagctgtgatcatgccaccgtactccagcctgggcaacaaagtgagaccgtgtatttaaaaaaaagtttattcattttttagcattgaatgaagattagattatttagattagcggtccccaacctttttggcaccagggactggttttgtgggagaatttttccgtgaactggggtggggggattgttttggaatgattcagccacattacatttattgttcactttatttcttttttttttttttttttttttgagacagagtatcgctctgtcgcccaggctggagtgcagtggcgtgatctcggcttacctcaagctctgcctcccaggttcacaccattctcctgcctcagcctctcgagtagctgggactacaggtgcccaccaccacacccggctaatttttttttgaatttttagtagacggggtttcaccgttttagccaggatggtctcgatctcctgacctcgtgatccgcctgccttggcctcccgaagtgctgggattacaggtgtgagccaccacgcctggcctattgtgcctttatttctattattattacattgtaatatagaatgaaataatgatacaactcactgtaatatagaatcaatgggagccctgaggttgttttcctgcaactagatgttcccatctcagggtgatggaagacagtgacagatcttccggcattagagtctcataaagagcggaaaacctacatcccttgcatgctcagttcacaatagggttcatggtcctatgagaatctaatgacatcactgatctgacgggaggtgaagcccaggtggtaatgctcgcttgcctattgctcacctcctgctgtgtggcccggttcctaacaggctatgaactgggggttggggacccctgatttagatcatcaactctgctctgaggaaaacagcagtgttgtagactggcatgaagtgcaacttcttctactctatgtagcaaccccttttctttctggtcctccttcactttagatccctgagacccttttccacattgtaccttggtcgttgtatatgaacatcaaacatgaaaggtgctagtgagatcccatctctatagaaaatttaaaaaattagctgggcatggtgggcctgtagtcccagctacttgggaggctaaggcaggaggatcccttgagcccaggagtttcaggttgcagtgagctctgatcgtgccactgcactccagcctgtgtgacagagcaagggcctgtctctaaaaacaaaacaaaacaaagcaaaacaaacatgagaagtgctgattcataccttgcaaagaggtttcattcggcagcaagttgaaattatctactggtttgtacatgagctagcacttcctcttccacatggcatgccattgatgttccttgatgtttagtgttatttgatagaggaatttgctaacaccttgttctcttttctctttgatgaaaatgtttatcattaactttggggctcttctaaagaatgttccattagtatgtgtttgtacctttttttttggcctctgaagagtgcagctttcaatgacgcctctatagttgtggtcttttccttttggtaatgaagtgcatcagttttgcactgagaaatgttattttgcccttgaggaataacttggttggtttactaaagagaccatcaaactttgaaagtgacatggaaagcttatgcggtttctacaactatttcagaagcttcataaatgctaaagcgtctgggctgggctcagtggctcatgtctgtaatcccaatgctttgggaagctgaggcaggaggtttgtttgaggccaggagttctagaccagcccgggtaacacagtgagactccgactctacaaaaaataaaaaaatttaaaaagaaacccacaaaaacaaaaaaacaatagaggactctgactttaggagcaaatgaatccagtgtctgataaattccaattttttaattattcaccattgtgctttctatgtgtacttcccttctttaactgcctgggtggtacatctcttgacatataggatatgtgtctttctggcttgcagtttagttccagtcaatagtgagcctcctaattgttcagagttgtatttatgccactcaccatgtgacttttatacttcatcaaatcattttgctctgtcaatccttctgaactgatgtgatggtacaaaatagaaaaagatggaaactgctaattttaacagatataaacataaacacgtacataaacaccagtgcatacatattacgaaaatatattgtgtaaaagcagtaacttgtaggactaagattaactactgtgttagtagtgcaagtatacatttcaaacttaatgattatataaagaatgaaacaggatatcagtgaccataatacctttaacatttcaaatttgtgaaatatatgtgaacaaaattgtttcatttatttctttgtttctttttgagacagagtctcactctgccacccaggctggagagcagtggcgcgatctcggctcactgcaacctccatctcccaggttcaagcaattctcctgcctcagcctcctgagtagctgggattacaggtgcccgccaccacgcccggctaatttttgtatttttagtagagacagtgtttcaccatgttggccagactggcctggaactcctgacctcaagtgacccactcacctcggcctcccaaagtgctgggattacaggtatgagccaccatacttggcccatttgtttcttttgaaataggaattcccagtgtagcttttgttgaacttccatgggcctctacatgtcctccatctgcaggttgtatgtacattgggctgtagccatttggtggcaaggaccatggtagaggccagtctgagagtgcacctggtagatccttaaagatgcaacctttgggaaccttgaacctttgattgctataaacaagtaaatcccctagttgatcatcactcaggaatcttggctaagcaaggcctatgaggaaattgatttcttgacagatacatttggaaggtctttaagttattctccttaccaatcacataaattttttaatgttttctataacttactgacttcagtcccatttttctttcatttattcaacaaatatgtattaagggcttgctgtgtgctaggcactctgaaagacaagacagcatttttgccctcttggaactaatgctttgtatatattattttctcctgtatcatatccagtttacactttgctacttacttttctatttttcctttttcttacctattatgtttcagatccataaactattttgtctatgtctttatttcaaattattttgtggccgggcacggtggctcacgtctgtaatcccagcagtttgggaggccgaggcgggtggattaggagatcaagaccatcctggctagcacggtgaaaccccgtctctgctaaaaaaatacaaaaaattagccaggcatggcggtgggcacctgtagtcccagctactcgagaggctgaggcaggagaatggcgtgaacctgggaggcagagcttgaggtaagccgagatcacgccactgcactccagcctgggtgacagagcaagactctgtcgtcaaaaaaaaaaaaaaaaaaattttgttctccagtctaaacataccgtaacagtcgtagcattaacctttgtgcattaaaacgcttaacatttccatccaaaaaatttcaggtatttttattttaaaattaaacaggttctccctctttcatccaggctgaagtgcagtggtgtgatcacggctcaccacagccttgaactcctgtgctcacgtgatcctcccacctcagcctcccaagtagttgggactacaggcatgtgccactgtgcctggctaatttttaaaaactttttttagagatggggccttgctatgatgcccaggctagtttcaaactcctgagctcaagtgatcctcctgcctcagcttcccaaagtgcttccccactggcatgagccaccataccaggtcaaaatttcacgtataacacaagaaatacattttttttttttttgagatgtagtctcaatctgtcacccaggctggagtgcactggtgggatctcggctcactgcaacctctgccacctgggttcaagtgagtctcctgcctcagcctcccgagtagcaaggattacaggtgcacgctaccatctcggctaatttttgtatttttagtggagacagggtttcgtcatgttggccaggctggtctcgaactcctgacctcaagtgatctgcccaccacagcctcctaaagtgctggaattacaggcataagccaccgtgcccagccaagaaacgcattcttataaaaagccaaatatatagatatagagtaaatatgaagtcactccttataattcccatcccaactgcctctcaagagccatgaaagagactattttctatatttttgctaatagtcttatctcttcttaaaatgttagtctgcaagatgggtttaaaaatacctcattgctttagctcatattggttgctattagatgggttaagcatcttttcttatgtttagcagtcatttggatttttgtgaattgccttttcatatcctttgccttttttctgttggactgtttgtttcttcttgagttaattttggtattctatgttttcctagaaaatgatctgctttgcctagtttacaaatccttatatgtaattacgttctctttcttgttcctaatttgggtaccttccttttttctttcttgattagatttgccagaggttctatcttgttagtcctttcaaagcatcagcttttcattttattaatcttcaaggtcatttaaaaaatgttttctgtttaattaattgccgtttttatctttattcattcttcatcctgctttctgtggactcagagaagacccgttcatgtagaggaaggtgggaacaaaggttcaaagatagttgtcgagggtcaggaaaacaattgttggcatcattctccttcacctcctcactcccaactgccatcacaaacacaggcagttcagaatccatcaagaaatgagtcaggaatcaggcagactgaatcagactatcagctttgttaataaggctgaagtagagagtagtgcttgacctaagatcacagtcaggctagtaacccttccctctgagttaaacttagccaacagaataaggcatttagaataaacgctttgagaggtttgaaaagaagacagttggaaatgaataaaacaatcacttagaggtgctgagggccaaatggcctcagggcagttcggtttttcagttctgtttggagacctagatcaggaacaaagaaaaatgagttggcagtctctggctggtggctgagtaagcagggccagagttggcagaaggaggtgatcttggggtttcagactagtcagtgaggcaagtgagaccagcagggcatggaaaaaaccacgaagagacaggagtcggggcttcagcttcttgtgagcatgcaaacccagctcggagggagtgtgatgctgggacagccaaaagaggagcagctgggggccagagaagggcattgcacatccagaaccctgatggcaggagagtcagagaacgggcacaccaccaagtgtgatgaaacttgtgggggattgacgatgagtcattcttcagactctctgggactcttgttctttccccaaattagtttaacatctgctttggaatcaaaagggtaactgcttttctctttctggctaattaaacaaatgcaaatgtatgcatagccttattgtatcctcacacagcctgggagggaagcacagtgtgggtggcaggtacatgacgctagaagcagagggtgtttagtgctggggtgggaggacagcaggaggatctgtcccagcgccagacgtcttccatccctacgggacctctcaaggtcatgctacatgaccttcggcatatgaattcacctggcaccacagtattgttcttaaaactgaaaatgtaccagcgtattgtaacttgtaagcccacaaacttcttgtttctagccatgtacttacagaaagcccttgcctttatgttttcacagggagggcatgatgaaccttgtcttatagctcatgagaaggccaacttcactaaccactccttgccgggtgtggtatgtttccctctgtaattacttctccctgtgtactttcttatggtaaaatgtcatgcttcagaacaaaattaaaaagtcatctaaagagatggtttggttatcatggaagtcaagttcctcttagtagaaatgagcagttatagtcagactttatagatactagaaagaagagcaatgtatttctaaactacatgcttgtgtcaaatttcagattttgtttaacaatttgtatattaatcatgatctaacccacctgttttggaagaaccctctcaaactgggtttttcctctgctctcacaccacaacaacagtcatcaacacggaaaaagacttctgtgaccaaatgtatgggggtttctctatagaagtagtggacaccagctaggtgttctccagttcaactctgacgctgtctacctggagagagcatcagatcccacagggcaaaactcaggccccaaggctgcctccttctccagtcaccagtctcaagtctgggcctctggaacttctgaccaactggcttcaagttggggttcccatgactcctctgggttcaactaatttgctggagcagctcacaaaactcagggcaacactaacttacattgatcagtttattataaaggatatcgcaaaggatacagatgaagagaagtgtaggacaaaggatggggaagggcatagagcttccacgccttccctgggtgcactaccctccagaaacttccaggtgttcagctgtccagacgctctctgaactgtgaccttttgggtttttatggaggcttcattgcataggcaccacaaccatgtagaaatgtgattggacaaaaagtacatgatctaaacctagcatgcctgtctcttcaagacttttcttggtctctctgtgtaacattccttcctttagggtatagttaggactctctctagtttgagggactcctgacccataattagagaagggtcctgtcttgggcacgtgaaaggacaggagaagttcagagagagagagagattctgtttcctgaggcctaaagtgccctgaaattataagaaggactataggcatcaggagccaggaaccggttctaatgcccatagtccttgttataatttgttatctatatctatctatctatatgtatatctatatctgtatctatatctatctatcagtcaatcataacaacataccatcagataaacaatttctatccatacccattttctgataataaaaactggatctgttgctggctaggtgaaactcggaaactcatgaagctttttaccttttttacaaatgggagtgtgccctttcatcctgaatcattagagtctcctaggtacccctctctgaggactcttattctaacagcctttgcaaaaattagccaaacatctgtttgaaactcactcagagtcattttcatctttgcctttctcctagttatttttagggttgataaatttgttttccaagagcaaacagagcatttttaagctttgatttttggctagcatttaggaattcttgttctgtgcagagctggctggatgcccacttaggaacttagcctgcacggagattccttcagtggaagagcattggtctggagtcatccatccggctcctggagcttggctaccctgatacttcccggtctccctgcaaatgaacacctcagcatgccattatagttggtcatcttactctgtttttacagaatccaggaggagagttcctgcaaaggatgtcttgggcagggtttaattatttctacgaataagaaagctttcctcaggtggaattgtatttactttctgcaatataagccatgaatttacaaatagagtctgatactgtcaggatacataattgttgttatgcttaagtagttttttttttcttgagatagagttttgcccaggctggaatgcagtggcacagtcactgctcactgtaccttcaacctcctgggctcaagcagttctcccatctcagcctcccaagtagctgggtctataggtgccataccaccacacctggctaatcaaattttttttttttttttttttggtagagataagggcttttatgttgcccaggcgggtcttgaactcttggatgcaagtaatcttcccgccttggcctgccaaagtgctgagattctaggtgtgagccactatgcccagccttaaatagattttaaaaaattacaaaactgttacatgttcatagtagacagtgtagaaaaatgtaaaaagcataaagaaaattaaaatttcctatcattccaccacctagataaccattctttcttttttcttttttttggagatgtagattccaatgatgtcatctcactgaaacctccgcctcccaggttcaagtgatcctcctgcctcagcctcccaagtagctgggactacaggtgcacaccaccacgcccagctgatttttgtatttagtagagacaggatttcaccatgttagccagactggtcttgaactcctgacctaaggtgatccatgcgcctcggcctcccaaagtgctgggatttcaggcgtgaactaccacgcccaacctaaccattcttaatatatagatttttttttcagtctttttatatgcctaaatgtaaatatgagctcctactgcatacactttacaatttgtattttccaccaaaatatattgtcgtcattgttccatatcactggatattttgtagtatcactttctctattgagatgccataaattcacatatatttacatttatataaatgtttacatatttataatatttttaacatttatagtatatatcatatttctatagagataacatgtattcacttatattcactgccataaaattcatacttttaaaagtgaacaatatggtgatttgtttgtatcttcacaaagttatacaatagttggcactgtcaaattctagaacattacccccccgccccgaaaacccagggcagttaccacccttccatcgctccttccctcatcctgtggcagccactcaagtactttctgtttgtgtgaattcccctcttctggacattgcgtagaagtggaattatacaatagatggtcttctgtgtgtggcttctcttttttttttgagacaggttcttgctctgtcacccaggctggagtgcagtgctgcaatctcagctcactgcaacctctgccatcctcccacctcagcctcccaagtagctgggaccacagatgtacaccaccacccctggtttgtatttttggtagagacaggatttcgccatgttggcccaggctggtttcaaacttctgggctcaagtgacctgcctgcttcagcctcccaaagtgctgggattataggtatgagctaccatgcccagcctgtgtggctccttttgttcaacataaggttttcagggttcatccatgtatcggtacattattcctttttactgatggataatatttcactgtgtggatgtacactttatatttatccattcaacagctgatggccactgggttttttctactttatggctactgtgattagtgctattgtgaacatttgtctgcaggttcttgtttgaacttctgttttcaattcttttggatatataccaaggactggagttactgggtcataatggtaactgggtgtaactttttgagggactccccaaactgtttttcacagtggctgtactttttcacatttacgtaggcaatgtatgagggttccagtgtcaccacatcctcaccagcacttgttaatgtctgttcttttggctagagccatcccagtcgatgtggagtggcatctcccagtggctttggtttgcataatgcctaatgattgatttttctaatgtggagcttcttttcacgtgcttgttggccacttgtattgtatagtctatttggagaaatacctgttcagatcctttacccacttttcagttgggttatttgtctttttattattgagttttcagagatctttacacattctagatactagacacttatcatatataggatttgcaaatgatttctcccattctgtgggttatcttttcattttcttttttttaacttattttaggttcaggggtacatgtgaaggtttatcacataggtaaactcatgtcacaggggtttgttatacagattatttcatcacccaggaagtaagcccagtacccaacagttaccttttctgctccctcctccaagcctccaccctcaagtgtctgttgtttcctcctttgtgtttatgagttctcatcatttagctctcgctaataagtgagaacatgcagtattcggttttctgttcctgcattagctggaggctgaggataatgacctccagctccatccatgtccctataaaggacgtgatcttgttcttttttatggctgcatgtcctttcattttcttgatagtatcttttgaagcaaaaggtttttaatttttatgaagtccactttatctagtttgtctttgcttacttctgcttttgatgtcatctctaagaaaatactgtctaatatagtcatgaagttttacagctatattttcttccaagaattacaaagttttagctcttgtactttgaggtgatttttgtgtatagtatgaggtaggagtctaactttgttcttttatatgtggatatccagttattccagcataatttgttgaaaagactgtctcccattgaattgtcctagcatccttgttgaaaatcaactgcccataaatttatgggttcatttctggactgtcaattctattccattggtctatatgactgtcttacatggacatgggatgtctgtttatttacttgacttctttagttttttcaatgacattttgtagttttcagtgtgtagactttccacttactcatacatattgataaatattttataattaacatttataaatattttatagttaaacataaatattttattctttttgatactactataaatgtaattggtttctgagtatatttggattattcactgcaagtatatagcaatacaattgatttttgtaagatcttgtattctgcagccttcctgaactcctttattagccctaagaggtttttttgttgtaaattccttatgattttatacatataagagcatgtcatctgtgattagagatagttttactttcttaccaatctggatgcattttctttctttttcttgcctaattgtccagactaaaacctctggtataatgttgacaagaagtggtgagagcagagagacacccttgtctagtttctgatcttaggagaaagctatcagattttcacgtaaagtacaatgttagtttgtgagtgttttgaacttgccctttatcaagttgaggaagttcccttttatgtctagttgttcagtgtttatattatgaaaatctgttggattttgtctactgctttttctgcatctatcgagatgatcatgtggttttgtcctttattctattactagggcaaattatactgattgattttgaccaactttgaatttctgggagaaattccatttggtcatggtatataatcctttatatatgtttttaggtttggtttgctagtattttgttgaggatttttctatatcttatctatatattttatctatatgacatctattatcacttttaatggctgcataaggcttaattatgtggatataccataatctaaccaattagactttaaattatttcttttcttgccattgttgttgttataatcaaggataagctcatcactgttgctcagatagctttgtattcattcatgattatttttgtaggatacattcctacaaatggaataatggaaccaaaggttatgcacagatgtttgtctcatcttgtcattgacattttcaagttgtttatagtggggtttttttttcagaggtttttaattttcaggtaagtcacatctgttttttctttatgtattctgcctttgcctataggctcagagaggcctctcctaccttattcaggataatctcctatattttctttcttttttctcttttaatttttcaagacaaaatttcactacgttgcccaggttgacgtgtggtctttcttctttttcagttttttgagacagggtctcactgtgttgcccaggctggagttcggtggctatttgcaagcacaatcatagtgcgctacagccttgatctcccgggctcaagcaatcctccctcctcagcctcccaagtagctgagactacaagctcacaccaactactgtgctcagctaaaacaatccattctttatcctagattagtcatgccatctttgtcataatctgaattcttatttctgggctttgccatgatccagtgctcatctttctattcctgaaccatgccattgtaattttttatttttctgatctattttactatctggtagtacaagtggtttgtgtttgtgtgtgtttgtgtgtgtgtgtgtgtgtaattttctcctttagagaagaatcaagttacttgatagcttctgtagagaataatcaattattctaccagatgaatttcaggacaattttataaataattttcttcatatttctaatctgattagaatttttattggaattacaacacatttataaaattgtttgcagagaatgaatatccgttgggagagcatggtatgcttttcatccagtcttcttttttgtcattcagtaaagcatgaatttggggggcgactgtaactttcttaccaggtttatttatagatgctattgtaagtaggattttttttaacgtgataacttatttaggtatattattttattatacagttgaatacatacttattttagaaaatttagaagctacaatgtgaatttaaaaagtaaatgacactcagtctgagagataagcactgttaacattttgtgtgtatctttctattaatagatttacagtctaatgagggaagtaagacatgatcacatgaaaggcttaataatctgagacactattgagtgactagcttgtactttttttctgcctagccttttttctccttttggaaactgcttttcccataactagtggagctgccaatcatccaggtccctctccacggccaatgggttggacagtgtatcacctcaggctcttttctgggagagactctctaatctggaatctcaaatgctaaagacctctagtcttgcagtgctgctgggcaaggccttcctatcctcagagcacctgtgtttgaatgataccagcttaggagagtgaagctacgaggtgattcaaaaccattcctgatgacatcattggacctcatggtctagagctggcttaaagccagcctgaattcatcctagactttcctaaatcagtaaagccaacaaactcaccattttgcttaagcaaaattgagttaggtgtctgtcatttgcagagtcccaaccactaccacctcctgtgtctgtgccatggtgccacatggggagtcacccagatgagttaggaccctgtatgccccttgccccccaggagagtgggtgttcctcagtaagagcaggttcagtgcattgtgcctgttgtctccttcaaggcaaagctggatggccatgagaggcagcagccttggccaggtggggcatggggctgccgtgccaggccaggccggctctgaactccttactgcactctgtccattagaatgacagagtctgagtatggaggttagaattatagtgaacatgggggattctatgtcacagaggctctgcaaacccatgccacctgctatataagagctctctgccatgcaagagcagactggctgccttccacacctattatccagtaaaatagcaattaaaatgcagcttgtggcaatgactaagcttagcccaggcccgctgatagagttcttggtgcctgtggatataacacatgttgcttgtttaccttcacaacatttcttcggtgtttttttctgggcagtgtatttggtccctgttgcagtagatcccattgtcactggggcttactctaggccatccgtagtagcagggaacgtggaccccaggctttgtgaggatgcccatatcattttggagctccctgaattcaaaattaagtatgaaaagatttatttagaacgaaaaaaaattgcaacaaattattggagcctaggagtttccgatgcctacctttgagatccctttagttggctcaccagaagcccctgctgtgatatgcttcctggttgtagcccgacttccccttcccacctagaactcacagtgttcacagggtcatggcaaggtggtggggcgtggctgaagcttcagggtaaatccatttgtgaagagcagactgagtttttgtttttgtttttaaatctgtttgatatctcagggagcagtcagcagctagccagcctacatcttgaaacccttacattttggagaggtacaaattaagcattgaggaccaagtaggatggaaatatgattttgcactttgtgcatgtatgcatgtaagaaagagaagagagagagagattgtgagaggcaggagagagacggggagaggccatcagaacttggggagagcagagcccgcctgcttcctgagtgaagcattgctcaagcgctctctgcccggccccctccgagtgtggttttcctcccaggccagcaccaaacccagaatagagtggctgacttgctgattgaggtcggcagctcccgagaagcaggagaagcagagtttttgcagtaagtacatcgttggttattatttaagacagagatggaaaatcttaggatagctggggaagaggtgcttctgctttaggtacaatgtcttacagacccagtggatcttggtgtgactaaggcagtgtgaatacattctcccgtggtgcatggactggataagttaatgccacatgcatgattttggggggctgaaaaaggatttgaaacccaccttttgacgtgttgaaagaaaatgatcttttctcacttgttttatcttgcaaggaaaggatgattaatgccaacttcaagttaatatatgaagttctttagaaaagaagccctgtgggtactaattagtagcagcgtggagattattttcccatccagggtgaatagggctgcttctgtgcattccttttgccaagtgtgggatgtctaaggtcctgtggagagaaccgcccactcgactagtgcttagcccctggaacgttctcgagtcatctccccttggaggagatcagcactgtagtgtgccctgtcgtctggcagagggtctgataatgtcgcaatgctcaacatctgggcaatacatacattgtgttagggtctgaaatgagatgtttgtgaagcccagatggcagagtttcaagcaataatatgataaagttggtggcttttctgggaagttatttattatatggttacttgagattgtttttcccccacatcccatcacagggctgaagataccttaaaatctctcttacccactctattttctagaaattaagtttttgctttttatttccttgtcccactgactctaatttcctataggtataaaatgtttagctcagcggtgcagaaggtccacactaagttttcttgggaaatgtggcttccaccccttctcgatagaatgctaaggtgctgctctagctgcagaactcactggtgtggctgcttctgctcctttacagctcagctccatggactctgtgtctctgtggttctgttttagagtagccgtgtttcacttcctttaacctttcctttaccaagtgagttaacatggaagcctgtctaaacagaggagcccccaaggcaggagagggggtgcaaaataagcaatactaaactttcatttgaaaacctggaatttgaaataaaccaccacctgtgaagtatcattcctcattccaattttatttttccaatatgttattttttttttagacagagccttgctgttgtcacccaggctggagtgcagtgtcttgatctcggcttactgcaacctctgcctcccaggttcaagtgattctcctgtcatagcctcccgagtagctgagactacaggcgcatgccatcacacccagctaatttttgtatttttagtaaagacaacatttcagcatgttgtccaggctggcctcaaactcctgaccttaggcgatccacctgccttggcctcccaaagtgctgggattataggcgtgagcccccacacctggccccaatacattaacatttttttaaatgatctaagtaattttgagctctcactgtacaacatcatctcatttgattctcccagcagccccatgaggtagctacctttttggtcttcacttaatagctgaggatgtggaggcctagagaggtcagagagatgggtgggcaggtaggtgagtggtgcagccaggatgggaactcaagtctgtctcaatccagagctcatgctctgatacggcatttcagtaaattcagaaattggagaaaatagtgacttaatcccacactttaaagcaactgttaaaatttctggattttttgctgggtgcagtggcttgcacctgaaatcccagctactcaggaggagaagaaggaggattgcttgagaccaggagttcgagaacagcctgggaaacatagcaaggccactgtctccaaaattttgtaaaaaaatttagccaggtctgggcgtcgtaggtcatgcctctaatcccagcattttgggaggctgaaacaggtagatcgcttgagctcaggagttcaagaccagcctgggcagcatagtgatacctcatctttacaaaaaaatcaaaacacaagctaagtgtggcgatgtgcacctgtagcaccagctactcaggaggctgatgtaagaagatcgcttgaaatcaggaggttgaggctacagtgagctgtgatcatgccactacatttcaccttgggcaacatagcaagaccctgtctcaaaaaactaaaaattaaaataagtaaataaataattagccaggtgtggtgttgcatgcctgcagtcccagctactccagaggatcactcgtacctaggaattcaaggttacaatgaactatgatctcactactgcatttcattctgagtgacagagtatgaccctgttctaaaaaaattatatatttctttctacctgtacaactagatattatagcataaggctttaaaattgttacatagtttcacaattattactatattattcttttgagacagagtctcactctgtcgcctaggctggagtgcagtagcgtgatctcagctcactgtgacttctgcctcccagcctcaaactatcctcccacctcagcctcccaggtagctgggattacaggcgtgtgccaacatgcccagctaagttttgtatttttggtagagatggagtttcactatggttcccaggctggtcttgaactcctgagctgaagtgatctgcctgccttggcctcctaaagtgctgggattacagggatgagccactgcacccagcctggtttgacaaatatttaatggcataaaatattttcttaagtgattggtccataagttatttaactattccctgttttttaaaattaggttgcttttccttttttgtgttttgctattataagtaatagattagtaaccgtctttgtccatggaactttccttatgtttttgggttgtatctgtagggtagattttcagatgtgggattactgggtaaaagggcatgaccattttaatggtgcttggtgtgtgttgctaaattactttatatcaacacagtgtgggggagcacttgtttaatttcatccattccaccagctgacagtatcatggggaaaaaagagtaagaaaaacagaaccagccgacagtatcacagggaaaaaagagtaagaaaaacagaacctctttatggtattttgcatttcttttaatacagctaggctgaacattttttacatgcttgtttacaagttgtactttctcttttgatcattttatgggatcgtaatgctggctttttggggccaatttatatgggtaagatttatttgccatatttttgtcagttattttccccagtctattgtttacctctttaaaatttttaaaaaacatgcagtcatttaacatttttatgtagtcaaattggtttcatttttttcgtaagtcttctatgttagagatctaagttctctgcttttaaggcatttatgttcttctagtattttctttcatggatgatgtgaaagtaaatttaaactggctttaaaaaatgctaaccagtttttccaatatcatttatgagcaactcttatgttttctaatattttatgattttctctttttatacctccagcttttctattatatgatttttctggattatttgattatttataggagcaatctgtttctacgccattatcgcactgtgatagcttttgtggcttttttttgtttgtttgttttgtttttttgtttttgagatggagttttgctctgtggcccaggctgaagtgcagtggtacaatctcgtctcaccacaacctctgcctcccaggttcaagcgattctcctgcctcagcctctcgagtagttgggattataggcacccgccaccacgcctggctaagttttgtatttttagtagaggtggggttttgcaatgttggccaggctggtctcggactcctgacctcaggtgatgcacctgttttggcctcccaaagtgctggggttacaagcgtgagccaccgcacctagcctgttgcttttatgatatgtagagagaatgagttgtgtggagtaatactgaggcaacataagattctggttaagcccataggcactggaggcagattgctcagccttaacttctctgtccctcagtcttattatctgtaaaatggggataaaattaataatagtttctattccatagggttgttggagtgaggaaacaaaagctaaattaaaacacacacacacactgaaaaagtatttgatgtaggtagatgtgtagagaaagtatttgaagcatatatagatgactctatatacatgagtatggattatattacatatatacataaaaagacatatgtatttttatagagtcaaacatgtcattctttccctctatggcttaagacaacctttcatgtaatcttgggagacaggaaaggttgtcttagccacagagggaaagaatgacacgtttgagttgcatatgcaaaaaacttggtacattgaaagacaagcgtgtggctgagagaaatacatgcagcacacataccacaaagagtactactcataataaatgatcccagcaatcaactagaaaaaacagacaccaaagaaaaatgggcaaaggttataaaaaagcaattcctagaaaaaggaatatagaaggccaataaacatgcaatgttcaacctcaataatagtcatagaaatgcaaattcaaatactcatgacgtgtcatttcccatgcaacacattggcaaaaatggaaaatatgaataatgttccagcatagagagaatcataggaagatgggaactggcaatcataaccaatgggaacaaaaattagtaaagcttttttgtatggcaaatttataaaatctatcaaaaggtaaaatatgcatacctttgatttgtcttagaaaaacactgtacatgtttttaagtaagcataaacaatacaaacatatttatgttaaaaattgtatgttaaaaatataagctatatatttttatttgtatgtatataaaaattcatttaataaaaagcactggatgtgtgatatcaaactgttgtttcctgtgtcacctctggagagagaagtagactaagggccaggttgctttttcctcttgctagatatacttctgtgtttgaatatttcatgagtctgaatttgtgcatttgtataaagtaaataaacaggcatttttccgggcccacaggcaagaagattcttgggagcaggatgctagctgtagaagctcaaggttgggaaagtgagtgacagattttgggaagaacaagaatttggtggcagtatttaaagatgcttaaaggtcttaacttatgttttagaaaaggaagcaacccaagaggcatggaggaaaagttgctttattgatgggcgccgacctcttccatctcctgtgcctgttttcaggctttgtgcagttgcgtccccacacacggctcgtagacgcccccgaggcactgtgctcctcactttcttttccaacatgtgttccttatctctggtttattgatttattatttatgtatgtatttttagagacagggtctcttctgtcacccaggctggagtgcagtgatgagattatagctcactgcagcctcaacctcctgtgctcaagagatcttcccacttcagcctcctgagtagctgggactacaggtgtgcaccaccgtgcctggctaatttatttatttgtaggtatagaggcttactacaggctgttcttgaacttgtgggttcaagtgatcctcccaccttggcctctcaaagtgctgggattacaagcgtgaaccactgtgcctggcctctctagtttaaaagattgtcatctgaggttcaaaataagcccttcatccattatccacccagcagacatccagcacccagtctgagctggcagtgtgctaggccctagggagacaagggtgagcaaaagagaacgtgccagcctccagggacctacgcatgggttggggaggagggacagtaaacactgatgaattatatcactgtgatggtggctgcgaagctgccattgggggctgtggtggagagtcacagagggagggatcctttccctgggtgggcaggaggcgcaaggaaactagggtcctctgaggagagcctgcatcgctgcagtctctcccattccatccctttctccgcacccctaccgccatgtcttcattcctttcactgggaccactgtttcccagattttagttctttaatgcctcttttcacagttgttgccattgtcaactaccattacttattacagttcctaaaactgacttaacattattaatgtatcttgaaaggacttaaccgcaagtgagaaacaatgaaaatgaaatgatgctaaatttaaaagttaggatgataggtaatgaaggcagaactcttgaatgtggtctagaaggcatgcatggggttgctctgatcacaaagggatgctatttatatgggagaaagggaatgtattaggattagatatttagctggcagggggactctcttgtcagtgaactcagggaggacactgtaggaaagagatgacagaaagagggagagactgcagagcatttatttattttgtttaattacaagcgtgagataagccagcaacacattacaacccgggggatcagagggtccctctgagacagactgcgggagccacatctggttgctacagtaacgggcctccttataacgagaagagccacaagtgcccgacataaatggcttggggcagaggagcaacaagcggcctaccttgctgcctcttggggaaggcagtctcggggaggtttcgcagtgggtaaagaatgagactctcgtggggagggtctcgggttgtcttgagtctaggagcttgagggcctctccgggtcttactgatgaggtcgaacatagggaaaggaagtcctcctggcttcacctgtgctgcctgcgagcccttactgcatgggaggagccccaggacaagaaggcggtacagcagcttttttgaactggcttgggatgctgagagatttgggcatcccttggccatcctgaggagggccaggcccacatgatgggatcagtgcaggggggggtggtcactggggccctcctgtggtccttcttgccggcgtcacccctgtagctgcaggaacttgaaacccctgccccaaacttgcattctccttcctgccccagtatgcctcctccttgctttgctgttccctgtgcctgtgagtttctctccctcttgtcatctagttcatgcttcttatcctggaagggtcaccaaagggtcttttccttcctgctgggtcatgtgccccttgaataagctcttctgtcactgtgtgactttttagtagcattttcccaattgatatctggtattttcaaggccatttgatagttccctacactggatggtgagccccaggtggggaggggtggtgtttggttttgtccatcctgtgtcctggtgcctactgcagtgcctagatacaggaggtgcttccagaatgattcttgagcaaacaaatgaatgagacagtccccagctgtttgtgtaaacgagtgaattcccacgactcgttttgggcctggttttttttcccagtgcagcagagcacagggaatgaaggggagaggagggcctggggagcggggatgtggggtgtgcgtgtgaaccatgggaggaagcctgcgttttattccaagggacacagggaccgactggagggctttgagcagaggagtgatgggatctgacctacattgctaaaggatcattgtggttagtgtggaaagattagccaggtggagggagagggctgaggagaggatggaggtgaattagaggggtggtggcatctggaagattgggctggactgggatctgtccggaatgtagagcccacgggtgcagcgttctgggcgtcaggatcccgtgatgtgtttgttgctctgatccgtgctgtaacttttcacaggtgagctatgctggggccctgagtttcccacattacaacacacacacaacttttcaatcaacaaacctttgctgcccccaaagccaccccaggagcccctggggcccatgtgtgccagttgaggccacggtggccccacctgcagctggctggccgttcagactcctgctgctgctcccgctgcctccttccatcacagatgatactgagttgttaccagtcaagacagggaaaaggcaccctcaaagcctcagctcttcaacctgccgttctgggcctccgccatccaccgccactcttgttttccagtgccattttgcacaacttccaccgtgctcgcgcgctgtggccaaacagcactactccttgcctgcttttgggggtgctcctcttctcacctggaatgccctctcctccagttttcacatgtcaacctcctacccatccttcagagttgtattagtctgcttggtcgctcacaacaaagtaacacagactgtaggtcttaaacaaaagacattaattttctcacagtactggaagcagacattggagtcaaaatcaaggtgttattttgggaggttgaggcaggagaattgcttcatcccaggagtttgagaccagcctgggcaacacagtgagaccccatttctcaaaaaagaaaaaaattagccaggcgtggtggtgcgcaccttgtcccagctactgaagaggctgaggtgggagggttgcttgagtgttgagtttgaggcttcagtgaggtatgatcatgccactgctctccagccttggcaacagagcaagaccctgtctcaaactatatgtgtgtatatatatatatattcaccttgtatcttcacatggttatccctctgtgtgtgcctgtgtcctaatcttttcttatatggacatcagtcatactggattagggctcaaccatatgacctcattgcaccttaattaccacttgaaagaccctctctccaaatacagttacattctgagacattaggggttagggcttcaacataggaagggagtggcggggagggacacagttcagcccatgactagagtctcagtgagatgccactttcccctccagcacccactgtgctcacacaccatagcctgttagtgggcttctttctagcactggttgctgtgtcctttggtgttcgttcgttcgttcgttcgttcgttcgttcgttcgttcgttcgttcattcatccatctaaaaatagtactaagagacatctagtccagactcctggactgtattattctttgagtcctgaccacaccaactatatctgacacaggtcacctgggacatttaattttttgttaattcatcaaacaaaatttctgaacacttctcatatgtaaggcattgatccagatgctaggcagcaggcacagcagaaggggtctgaatgccagccagctgctggtggggccactgatttgcctttccttttaaatgcaaaggcgaatcagagttggcacttccagttagttggagagacataactggcatatacagtcatacaagagaggacatagacaaaatgcttggaatttagagcaacaccaaatcacatttgtctttgtaggtgtggggagatggcagataagactacaagggtgaactgacatttgatctgggacttaaagatgggtaagatttgtgtagataggtggccttttgagtttaggcttttttcacttagcatagtgcatttgaaatacatcctttttgtgtgtgtgctattcattcacttttattgctgagttcattctttctattgctgagtactagtctaatgtggggatgcatcagtttatgtatccactcactgttgagggagagttaggttgcttgacttttgctgttacgaaatcaagctgccatgaacattagtgttacagatgtttgtgtgaatacaaattttatttctcttggataaatactgaagagtgggattaatggattgtatatgtttaatttttaagaaacttcagcactgcaaagtggctgtaccattttgcatttccgccagcaatgtattagagttccagttgctccatatccttgccagcacttgatactgttttgttttgtttttaaatttttagccattctagtaggtgtgtagtgatagctcttatggtttcaatttgcattttcttaatgactaatgatgtcaagcattttttcatgtgcttatttgccatccaaatatcttgtgtggtgaagtttttatttaaatatttggtcattttttattgccttgtgcagtttattattattatttgttattaatatggacatcatttgttatttttaacaaaaataacaaagaggctgggcactgtgactcacgcctgtaatcccagcactttgggaggcgaggcgggcagatcacctgaggtcaggagtttgagaccaacctgaccaacatggtgaaaccctgtctctactaaaaatataaaaattagtcgggcacagtggagggcacttgtaattccagctactcgggaggctgaggcaggagaattgcttgaacctgggaggcagaggttgcagtgagccgagactgtgccgttgccattgcactccagcctgggcgacaaggggaagactccgtctcaataaataaaaaataaaagtaacaaataataacaaaaatggttattattcaagaattcaagattcaagtcctttatcagttttgtgttttgcagatatttcccttccagttgatggcttgtcttttcattttgttgacaatgtcttttgaagaccataagttttaaattttgacagtatcccattaatcaggtgggtttttttgtttttttatcttagttattttattgctcatatttttggtgttgtaactaagaaatctttgccttactcgaggtcacaacagttttctcctgttttcttctagaggttttctagtttcaggtttcacctttaggtcaatgggctgtctttaatgtggaccagacactgggcccacaggtgtggaaccacagaggaatgagacagagcccttcactcagggaccatctgggcaagggaggtgggggtgggagtcacacagggaaacagtctttgtctggtgtaaggcctgctgataagcctgggtccagggtgctgtggacacactgtggtgtggaagcaggtctgtgcccagacaaggggctgtgaactgaggtttaccagacagtagagggtaagtgaaaagcaggagttcaggctgggaagcctgttctgggcttagagtggccttgggcaggcctggaggctggatgatagaactcagcatccctgcagctgctggtcatttgctgtgcctggggtcaaagtgcaagacagctggcaggagtgggcagaagggagcaggggcctgagcacttggtgtgccttatcctccaacaaagaggaggtggaggtggcttcatggcatggctcaggctgtgctctttgagggtcgggggtaactgtccctctttattttgaaagtcagatgtgtctgtgtcataaagggcacatccatagggggcagcggaagtgctgttacataaccgtttctgtccctcacgctggaaacagatcgcacagcagttgctgtacttgctgttccttgtagacttactcctgtgcaaggaacgtgtaatgacaaggtaatcccaggagcagcctgcaaaattatccgtcgtatttgtggttcctgtgtatatttaaaacacaatgctagaagcgattgatgctgacgaaggatagggcatattccaggcactgaataaattaaccctgcaaagcacagcagttgctttcattagccagctggcactgcaggaatattgctaaagcctgtgggttagaaaagaaaatctcaggaatgcgagaacaaaaaagaaatcagccacattcagtgatttaacttaatctggcaacaataaggaaatccagaactcacggtgctctgagcaatggcggactcccgctgcatgtgcgagtggatggatattccctgttcagtggaggggatatccaccacgactctgggtacccacggcgggatgcagatgtgagttagggccatgcggcgatgatccaggttttgttcctgcatcctctgcaactagagaagctccagcaaagttctgtgttcccctcttttcttcctgatgtccccaaggagtgaagcaaatgaataggcctagctaatgtgccatctctctctcccttctctacctggccaggcactttctgggatggctgctgccatcatgtccatgacactgaaggcctctgctgcctgcagtcccactgctgcctccgccaccctgggcaccactgctgccttgttgccctgtggctgtgaggtgccatagtgccaagtcttcagcacgccccagaagccatgatgagtatggtggaggcctcagaattttcctggggaagtagctctttccatgttgccttgatggccctgttcccacctcctgtctctccccctaggccaagtgttatcccaggagacccttcacttccacagacagacagacagactgccagggaccctcctcagccagcctcttcacatgccgaggccacagcactcagtgtggttgggtccagttgagaccctgctgctcatgacttaaggcttctgtgcattgaattaagccactaggggacttatgagatcaccctctggcttctcttgttgggtcccatacagccagtatgtgtcaccaggggcatgtggcatgtgtagcctgcctctcctgagtttgcagagctgggctggctcctccttgattttatcttcctctggaccagagtggctgaagtatagtgagcagagggaggggcagtggacgtggtgaggggccagacctctccatccatgggtgggggctctcgttatggagggtcccttttttgcgtctgtgctcagcagtgcgggggaagagggtttgtccccttcctcccaggtcctcatcgttcaaatgcacggaagcatgttggtagagcacacagaggttttgctgggtgggtggggcagcatgccctgcagttcttgcattgtttccagaggaaatagaatagaatgcaacagaactggcctgcctgttgcctgggaagctgttctcctgacatcacagggctgtgcccatatccccgcttggcttaggggcccctaagttaggaacaaagaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtg

SEQ ID NO: 1534 - DNA, 227733 bp, Homo sapiens
agaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaa

SEQ ID NO: 1535 - DNA, 150149 bp, Homo sapiens
agaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaa

SEQ ID NO: 1536 - DNA, 81090 bp, Homo sapiens
cggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaa

SEQ ID NO: 1537 - DNA, 158666 bp, Homo sapiens
cggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaa

SEQ ID NO: 1538 - DNA, 83438 bp, Homo sapiens
cagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagta

SEQ ID NO: 1539 - DNA, 43707 bp, Homo sapiens
ctaaggcgctgcagtttctttattttttctttttatagagatggggtcttgctgtgttgcctgggctggactcaaacttctggggttaagcgattctcccacctcagcctcccagagtttgcagattacagccataaaccaccgtgcccagccctctgcagtttctaaaagaggttcatcaatacaaattctcagcatcattctccaattaggctcccccattaaccaattgtttctaatgaccgattattaatttgcaagagaattcttcctctaactcataccatcccactcagacagagttcagtattttccttcactttaatttttattgcttctccagttcagataattcagcgcttcctctttcttcttcctcaccttgttcatggctggctgttccatcagcagaactacaaaaccagaaaggcaacaaaatttgaaaggtttctcggcatcctccaaggaggctgtgggggaatatgaaaaagaaggtggtgtctggagccacacagaccagagtccaaagcccagctctgccattattagctgtgtgatcttgaacaaatcactcacctgtaaaatgagctcataaagcttgtgaatgtgagaatgatatcaggtaataaatgaatggcaattcggtgccaggaatgtgctgagctctcaatttatggtcaagaacatcactgggatggctactaatcacttggttagacttttggtctcccacatggcaacggagaccaactgaaaatgtgttcagaagtctgtagttgttacctctagtggatcctgtccctccaactagtaagagtcaaggaagaggagctggatttaaagcattcagaatgtcctttctctaacagtaacaaaatcacaagagctacatttattgagcatttattctgtgctaggcagtattaacatgtattaactcatttcacccttacaatcactctgagataggcactaatatcactcccaattttttttttttttttgaaacggagtttcacttgtcacccaggctggagtgcaatggcatgatcttggctcaccgcaatctccgcctcctgagttcaagcgagtctcctgcctcagcctcccgagtagctgggattacaggcatgtgtcaccacgcctggctaattttgtatttttagtagagacggggtttctccatgttggtcaggctggtctcaaactcccgacctcaggtgatccaccggcctcccaaagtgctggaattacaggcacgagccactgcgcctggcctatcactcctatttttacaggtaaggaagcagatcagagaggttaagtgacttgcccaaactcccgtaatactagtagatgacatacccaaaatagtaagaatagtggttttatgtaccaggcatgtctgtactcagggctttttttgtatggttgtataatttgttgactgcacaaaagagcctggccaaaggggcaagctgaggctgaaacgtagcccctgctctgtttgctccgtaccctggcatgaggctgtgccgcctggaggaagggacacctttttctaatttgacaaagatgccatatgagctctcagaggctctgttaatgctttatgtgtgttaccttctctactcctcaaaacagctctgtgggctagatatgaataccctcattttatagatgaggaaatccaggcttagtgagttcaggtcactgagttaagtcacttggtaagggataaagctaggatttgagcctgatgccaaagcccatgctctaaaccagtaggccactatactggccccatccctaagtgctcaataagtgaaaaaaggaaaaaatacataatcatctggtttttaccttaaaaaatatggcagttctaatgaggccccagtaagggctactgaggtccttagtaagaaaaataattagaggccgggcgcggcggctcacgcctgtaatcccagcactttgggaggccgaggcgggcggatcacgaggtcaggagatcaagaccatcctggctaacacggtgaaaccccgtctctactaaaaatacaaaaaaattagccgggtgtggtggccggcgcctttagtcccagctactcaggaggctgaggcaggagaatggtgtgaacctggggggtggagcttgcagtgagcagagatcacaccactgcactccagcctgggcaacagagcgagactccatctcaaaaaaaaaaaaaaaaaaagtaaaagaattgatcaggaagtcggagcatcggctttcagtgctccaaactgtggctttatgcttattaactatttctgtatttcaatttccttgtctgaaagtaagaataacattataaaggaacaattcttgtagttgtttgcaaagtgtttatgcatacatgataaccctcatatcaaaatgatcctcacatcatcaaacctgggagaaaggcattattattactcttttgctcaatgaggtgagtaacatgctcagcatgagtagggcagaatgggacctgaaaccagggatcctgacttatcttgtacttcttgctaagtaccttagaacttttggagcacctgcagcctgcctggtggcccagacatcacatggtgcacatgcaagtcagagagcagttggaaactgacaataggcacgtgaccacactctgttccttcaggagacttggcaggaaggagcactctgggaggagtctttgtttggctcccatgcgtgaaaacaaaacttctgcctttgcaggagctggggcagtctgagttacagacttgggtaagactttcagagcttccttaggagggaaggatggcctggtggcatttaggttcaactcctttctgacagggctcagccttcctgtttcccatccttggctgtggccaggttcaaaggaaataccatctgtggaagcactttccaaagaggcgtggtccaagtgcagaatgtttttcctctcctctgtggatctcaggaagccgattccatctgtgctcaaatgacagacttgctcatcctgtgataaaatgtgggctgctgcccccaccccagcttggtgcccttctaaaatgaaaacatgcatgtgtgttctctccccacctccccaacagcaatccgccactatctctggctctgcagacctactctgtgcaggctggcaagtgctgccatgcacaaggccccttctgggttgtgggtacactacgccttatgcgggcgaggtatgtggataacagggaagggggaaatacataaacatacagaccttccagcgattgccacattcattgcataagacaaaggtagtcatgggctcatcagcactgcgtgtctgcacctgagagagagaagaaccactcatgaagtcactcccctgttctaggacctgccatggctcccactgtctttaggagtaggtccaaatcccagaggttggcactgagattcccaccccccgctggcaatttccttatcactgacaactccataatattagtattatgctttcctctcctctggcaggcagtccatcagctcactcccagtatcttactggcttaacctggccttttgcacttccgctttttttttttttttttttttgacagtggagtctcgctctgttgcccagactggagtgcagtggtgccatctcggctcactgcaacctccacctcctgggttcaagcaattctcctgcctcagcctcctgaatagctgggattacaggcgcccgccaccacgcccggctaatttggactttcactcttgttggtcactcttgttgatcttttgtaacagacctctcttctcttgcctcaagacttatctcctacaggaagtattccctgactcacccctgaacacatcctactggacaagttcacaggagtgagctgcaagcaggcttagcggtctagttcatcttccttattttactggtggaagacctgaggcccagagagggaaagtcctaaatatcattgggactatttaatgttacattttctcatcctcttagcctcatcattcaggtgcaggaaccgggtatcccacagtaaagccctggcatttccaggtttaacagctcctgttctggttttctaaggctgtccttggctggccacgacatgtagcaagtcattactttgctgacaatcagctacgaatgatgtcagctgggaatctgtggtgtgggacgagttatgcccgccaccctccttgggtgagccccagcagcccagcagtctgccaggcggacacagcttagcgcagcctggtcactggaaagcagtgacgagcagagagaaaactttgctagtgggcagtttacttctagaaagaagtgaggcacaggaagcgcatcactccacacggaaaggtgcttgggagagagcagaagcttgcacaaacatctccggattccagaactggaattctccaagggactcctccggaatggcaaggctgactgcatttctgccctggccacagaatgccgcaggcaaggtgctcttgataaatggtgtgtgccgaacagacggagaactctgaatagagttctagaatgactagacaccagttagaatccaaggatatttgtgctctaagggcataccatgtgcaacccagaaagaggaggccattctctggttttaagagaaggggcctccacagccttcccaagttccccatgccagggcaatggtcttcaactttaggactcagagctaaagcccttaggctttattgaccaagttagctggattgcaggcagaatggtgtggatcttgtttattactacctctgacattggcctcctttcttgggcaaggctaaaaagcccatctgtggcctgtgtgggcctcagtttccctgggtgtgtaatgagggagctgggtttcacattgccaagttcccttccaactgtctatgactcttcagccgccatgagtctgattcttcttattgtcacgtcagggcagaccagaacacactgaccaagcctcgtagacacatagcagggatgattctaaactcagaggaacattgtctagaagccacaggtgcaccacattagtgtaccaaggcttgcccttctctctgcagcctggagagtttttaaggttttctttgttttgttgagtcagggtctcattctgtcacccaggctggagtgcagtggtgcaatcatagctcattgcagcctcaattcactgtagcctcaacctcctgggctccagtgattctcctgcctcatcgccacccatttcccccgcatccagtagctgggactacaggcacacactaccaagcctggctaatttttgtatttttagcagagatgacgtttcaccacgttgcccaggctgctctcaaactcctaggctcaagcaatctgcctgcctcggcctcccaaagtgctgggattacaggcgtgagccactgagctggcccagcctagagaggttttctttttgttgtttgtttggtttgagacagagtctccctctgtcgcccaggctggagtacagtggtgcaatctcggctcactgcagcctccacctcccaggttccagtgattctcctgcctcagcctccagggtagctgggattacaggcacgtgccaccatgcctggctaattttttttttctttcagatggagtctcactctgtcgcccaagctggagtgcagtggcatgatctcggttcactgcaagctccacctcccgggttcacgccattctcctgcctcagcctcctgagtagctgggactacaggtgcccgccaccacaccctgctaattttttgaatttttagcagagacggggtttcaccgtgtttgccaggatggtctcaatctcctgacctcgtgatccgcccgtcttggcctcccaaagtgctgggattataggcgtgagccaccgcgcccggcatttttgtatttttagtagagatggggtttcactgtgttggccaggctggtctcaaactcctggcctcaggtgatccactcgccttggcctcccaaagtgctgtgattacagacatgagccaccgcacccggcaaagcctagagagttttaacgctttctcccctctggctcttccctaagcttctctctgattttccacctctatgcccctgcggcctcctgcacctccggcccgtcccctcactgtccttacctggttataggtgcagttcttcttcttgcatttgctgcactggaagaggtcagtggtggtgccgccagtcttggccatctggtgctcacggatggcctcctgggtcatggcattcctcaactccctcagttcatcactggccatttcctggagaaaaaagagtctacccttcagggctgaggagtttcaggggccctgccctacacccggtttctagaaagcctgaacagaaaaggaggtaacatgctttattgactgcaaggagctggaaggaggcctggattccgggtcctgccccagctgggagaaagctgtccccgcagagtcctcctgccgcccacggctggaaggtcataatgcacattcaggtgagcagcaggcaaacagcctctgcccgaggacgagcactcctgtgtacatttcttcagatctggggctcatcctgcctgccaggaccttggccttggcctgaaccttcctgcttgagctgacttgatcactgccacctggtctatgatgttccccttagccttcctctctagacttgacccagtgctcttttacgctgtgatcactgccctgctgttctgcttagtgggaaccttggcgcaactacccatgacttgctgctgctacccccatcctgaagctcctgggctcacacaactaactgttcatctgatgagcatgcatccaagatcatctttttctgagagtttctacagaagagtctccagtctcccaccagctcacagtagacactccgggtctgcatcacccacacctttgctttctctgtccatctccctggccacttgtctccccttaagcctctgccagaggacagcagagagggagctccagttaagggttggtggaaggggaaggagggtggctgacgcgaatctcaaaatgaggattttaaactttttttttttttttttgagatggagtctcgctctgtcaccaggctgaagtgcagtggtgcgatctcggctcactgcaacctccacctcctgggttcaagcgattctcctgcctcagcctcccgagtagctgggactacaggctcatgccaccacacccagctaatttttgtatttttagtagagacggggtttcaccatattggccaggatggtctcgatctcctgaccttgtgatccacccacctcatccttccaaagtgctgggattacaggtatgaaccactatgcctggcttaaacattttaattgttgctgtctgtcctgagtccttaaaccatggagaagaatgctggcataaaggtcaaagcattttagtgtgctcacctttcattataaccacttaggcttcttgataaaatgcagattcctatgaatctgaattgctaagggcaggcccaggaatatgcattttttaaagttctttatttggttatttttgggacaggatcttgctgtcacctaggctggagtgcagtggtgcgatcgtgactcatggcagcctcaacctccccaggctcaaacgattctcccacctcagcctcccaagtagctgggactacacccagcatgcaccaccaaacctggttaattattttttgtatatttttgtagagatggggttttcccatgttgcctaggctggtctcctgagctcaagtgatctgcctactttggactcccgaagtgccgggattacaggcatgagccactgcgcctggccagaatatgcattttcactagtgtcctcaagttattctggtacgtattaatgtttaagtcctagtgtgttaaattcaaaggctaggccctaaccaatggcaggagaatatagaaaaacaagtcaatgaaagccatttacccatatgagtaaaaagtagctgactttaatttgaggggattttccagagcataaagcatttgcccattcaaaatttattggatgtggccaggtgcagtggcttacacctgtaatctcagcactttgggaggctgggacaggtggatcacctgaggtcaggagttggagaccagccaggtcaacatggtgaaaccccatctgtactaaaaatacaaaaaattagctgggtgtggtggcgggcacctgtaatcccagctacttggaaggctgaagcaggacaattgcttgaacctgggaggtttaagttgcagtgagctgagactgcaccattgcactcccgcctgggcaacaacagcgagattccatcaaaaaaaaaaaaaaagccaggcattggtggtgcatgcctgtaatctcagctatttaggaggctgaggcaggagaatcgcttgaacctgggaggtggagggtgcagtgagccgagatcacgtcactgcactccagcctgggtgacagagtgagactccgtctcaaaaaacaaaaacaaaatctattggatgccaatttactgaatgcctttaactgtatcagtttgcaggtaaaccagctttggttgtggggatgccttgatttgtagtgtttgtcagcttccatgggacaaaatgctatggtcaatgggacaaaattccatggccaatttcaagctgctaatgtgatataactgaacgcagagttgggaagagctacacatcaccagctcccttgagctggtaggagctagctcaagcatgctactgcctctgagtccaacggattcagaaaggaagatctggttcctcctcccaagtagtgctaatctgatagggtagccaagcatttacacgagattgcaagagagggaaggaagtactaaagtgaaggcatataaggtgcaggggaaagcaacagggtatggtggttaactgtttggggtctggtgggtcatgaagaagctagtactttaaccagtcttgaaagataggagttcctggggtgggtggtggcacattccagacaaataaaacagcagggccgggcgcagtggctcacacatgtaatcccagcacttcaggaagccgaggcgggcagatcacctgaggtcaggagtttgagaccaacctggccaacatggcgaaacttcgtctctactaaaaatagaaaaattagccaggcatggttacatggttacaggtgcatgcctgcagtcctaactacttgggaggctgaggcaggagaatctcttgaacctgggaggtggaggttgcagtgagctgagattatgccattgcactccagcctgggtgacagccagactccatctcaaaagaaaaaacaaaaaacaaaaaacagcaggcacaaaagatcagaggacaagaatagcatgtttggggaaaagtatttggggtaggttcaagtcaagcatgggagatgtggctggaggtcagattgtggaaggaaggtcttgtgtgccagctaagaaatagagaacagaaaaatctatccagccacacgccaattcattgacttctctgccctgcctcattagaatgaggcagcatcagagacacggagaataaatacaacactgtagaaaataaggtggaaaatgaaggaaatgagagtcagagaccacaattctatccctatttgttgagccctgtgatgtaccagacactgttgtcagtgctgggtggactgtgaatgccggttctcaggggactgacaggatgctatgtccactcagcagcgctcatgggtatctcagagcctactccattctttgctatgtctgagtagggaagaaaagagaagaagaaagaatgagggagtcaggtaaacaaggaaagaggcataaaaagggagtcagggaagggagttctgagagagacaccgtccacatgggttcctgatgggcgcttcccctcacagcaggcagcccaagcccaagctaagatttttctgtttttttttctttttttctttctttctttcttttttttttttttttttgagatggaggatctcagctcactgcaacctctgcctcctgggttcaagcgattctcctgcctcagcctcccgagtagctgggactacaggtgtgtgccaccacgcccggctaatttttgtatttttagtagagacagggttttgccatcttgaactcctgagctcaggagttctgcccacctcggcctcccaaagtgctgggattacaggcatgagccacctcacgtggcctgttgaaatcctaaccccaaggcaatggttattagggggtctttgggaggtgattagctctcaagggcagagctctggtgcaggggattagtgctcctctaataggggcctgagaaagacccctccaccatgtgaggttacagtgagaagatggctgtctatgaggaagcaggccctcactagacactgaatctgctgctgccctgatgttggactgtccaatctctagaaatgtgagaactaggccaggtgtcatggttcacgcctgtaatcccagcactttgggaggctgaggcaggtggattatctgaggtcaggagtttgagaccagcctggccaacatggtgaaatcccatctctactaaaaatacaaaaattagccgggcatggtggcacacccctgtaatcccagctactcgggaggctgaggcagtagaatcgcttgaacctgggaggtggaggctgcagtgagcccagattgtgccactacactccagcctgggcaaaagagtggactccatctcaaaaaaacaagcaaacaaaaaaaaagaaatgtgaggaataaatgcctgttgtttataaactacccaggcgatgttcgttatagcagtctgaactgacgaaagacacactgtaaagccaagttgcaatttataactccaggcatatgttgctatttacccaaaaagatcagatattttaaattaggcagaaagataaccctggtctacctgtgccaagttccccatttcatcctaaagccaaggctctttgctgtttgttttgggtgtttgaggaaagcagtgaaccctctcctcagaagaatgtacatacacacactacataacacagacacacacttccacatgccacacatacacaaaccacacatgccacacatatgctaatcacacaccacacacatacttcacatgacatcatacacacacactccacacatcatacacacacactccacacatcatacacaaaacacactccacacatcatcatgcacaatacacacacactccacacatcatgcacaatacacacacactccacacatcatacacaccacacactccacacatcacacactcacactccatacatcatacacacatattccacacatcatacacgccacatacactccacacatcagacacacacactccacacatcatacacacacactccacacatcatacacacacacacacactccacacatcatacacacacactccacacatcatacacaccacacacactccacacatcacacacacacactccacatatcatacatgccacacacatatactatacaccaaacacacctcacacatcatacacaccacacacacacccactccacacatacacagcccccacactccacacatcatatataccagtggtccccaacatttttggcgccagggactggtttcctggaagacagtttttccatggacagggtgggggatggtttcaggatgattcaagtacattacatttattgtgcactttatttctattattattacagtgtgatatatataatgaaataattatccaactcaccataatgtagaattagtgggagccctgagatcccttgttttcctgcaactagatggttcccacttggggtgctgggagacagtgacagatcatcaggcattagattctcatgagaagcatgcaacttggtttcctcgaatgcacagttcacaatagggttcgtgctcctatgagaatctaatgccgtcactgatctgacaggaggcggagctcaggcagtaatgcgagtgatggggagaggctgtaaatacagatgaagcttcgctcacttgcccactgctcacctcctgttgtgtggcctggttcccaacaggtaccagctggtggcctgagggttagggatccctaatatataccatacgcacatgctccatacatacacacacatacataccacacatgcactccacatatacacaccacacacacaccccacatataccctctacacacctcacacatcatacgtaccacatagacacgcactccacacgtacagcccccacacatgccacacaacctagcgctggggccagacagcttgcctcctggctccgactctttctagctgtgtgcatgggcaaattcgtttactcctctgagcctcaggatcctcatctgtagaatggggataatacacctttctatctcagttggtgtgaacataaacttggccaattcgctgaacacacttagcacagcacttagaacctattagctgtgttcagtatcctgctagtccagagcccaggggggaggctgagatgaggctggtttgaaaagctccctggctcactgctgatgagtcacgagccactgaccctctgcactaggcagggctagggggacctggcttcctgcctcaccatgcagatgccctgctctcacctctgccgtcatcttggctataagccctgcggagatggccccactgagcacgttccgccgcaggccggggttcctggggtccttgaggttgcttatgcggctgcgcacgcggttccggtacttcatgtccgtgctcttgagctcttggtagatatgtgacacagtcaagggccggccagccattcatggaggggcacagaagggtgcaggcctggccctgacgcctgagagctccagaaccctttcttcctctcctcggacttctacaggagttgggcccctcttttgtgacctctgactctccaagtggtgatgtctcttgggcatttgtggtcagccaagtagcagagaaagaaaatagcttctggggtaagatcagatcatagcaagcactatagtgtcagggacaccaggaccctgggtttgtctgagcctcttgtgtgacctcaggtgagtcacacaacctctacacgcctgagtttccttatttataaaatacaaggattctgtgagctaagccacgtgatgcactagtgtggtgtctgggatatatcaaatgctcaacatgtatgggctgctaagatgatgacaaggatgcggataacttctagtttggaagggcccctggaggttgtgagtccagctgtcagaggaaaagattaagagccacatgtttaaggctctacgaagtattgcaaaaaagaaaccactgagctttgtttaatctggtgttcccaataaatttgattatagagtccccttcccctctgtcctttcccctacaagacctgttaccatcccatggaacccacgctgggaattgctggtcagagttacttctcccattaacagatgaggaagctggggcttagaaagggtgtaggaccttgctcaaggccaccaggcaaattcccggcagagacagggctggaagccagacccctcctgacggtaactctctccactcacccggcaggaagtcatccctggccaccaaccacagagtttctgtccaaacactgcatcctaggcaggcttccgagcctcccactccctccaccctctggaggagctcggggaacacagcctcattttcttggtctcctgagccaaagaagatcaggaagacaaagctgttgctgggaagagccatatacaataaagagactgcggagaatgtggaaaaatgaaaacagatgacttgctagaagtggtgggaggggaggtggtattctttcttttttctgttattgttttaatgttgtttgtacaataaaagtgtgaaaagcaaagaatatgccacaatgcatgtgaaagccaaaaaatgtgttttaaaatgtaccacttgggattcctggggtgtattgatatgcggagccagcagggctggcgatactttcaccagcctctttctgactctgtctccatgtcccaaggccacagaggggacgaggcagagagcagaccgggggcaccggcccctcagaggaacttttggctgcattgttagcacagggccactccaaagaggacagatctattttaggacatagagcagtcaagcccccaaatgtaccctccccctgacctccagctggctaaaaacaaagagctaaagtgtttgatgcagctttgatttcctctcctttagaagagggacattcaggctgggggtggtggctcacgcctgtaatcccagcattttacgaggctgaggagggaggatcacctgaggtcaggagttcaagaccagcctggccaacatggtgaaaccccatgtctacaaaaaatacaacaaaattagccaggtgtggtggcgggcacctgtaatcccagctacttgggaggctgaggcagcagaatcacttgaacccagaaggcagaggttgcagtgagctgagatcatgccactgcactccagcctgggcaacagagcaagattccatctcaaaaaaaaaaaaaaaaaggaactttcagtggatggaggaaaggctgggagtggaactttgtactggaccatctgctgttgtttcaaactgggcttaaaggtggaaaggacctgcttggagggatgactgttcaggagaaaatgaagatgaaactcgtgatagttctcataccttgtgttctgccttcttgaattaacaggaaatgatgaaaatgtactttttgaggtgctgaatggctccagacttgttgaggtattgctgattaatcattaaatgagagtagagagaaaccaccagaaaataagttggagggaatcagggtaggccacaggaagaagatggaaacgcaaatttgtcgtctgcagattggcccctggctctcctcaacagaccctgctgaactccgcaggtagaacccaggagccctcaaaagggtcgctcacacctcggtgtgacacttagacttcctgtcccctgactgtctccccgctccaataccatgcaaacctttgtctctagtaaaagaagctccatgttttcattcagtgggggccaagtggggtgggattttttttctcccaagccaaacaccttttggtgcaacagatctatgaatacatcccagtggtggccacctctcctgtctacacaaggcccctttcaggtgagaagttggggagcagggggcacatggaaaggattcaatacatggaatccaaagacaaagtctccagtcccgctttgacagttctgagcctcagactcctcatctgtaaaatgggaacagtccctgcctcacagagaatgctgtgagagctaacagaggtaggaagtgtcaattggccattgcagtgcttgatatatatttgggagtaaaaaaacagagggcagggcgctgggtgtgatggctcacacctgtaatcccagcactttgggatgcaaaggtgggtggtgcatcacctgaggtcaggagttcaagaccagcctgaccaacatcgtgaaaccccatccctactaaaagtacaaaattaaccaggtgtgatggtgcatgcctgtaattccagctacttgagaggctgaggcaggagaatcgcttgaacccagaagttgtaggttgcagtgaggcgagattgcgccatcgcactccagcctgggcaacaggagtgaaactccgtctcaaaaaaaaaaaaaaaaaaaaaagggcgctgttaacatcagaggatgggagaagggaaaaggctgagcatgggaaatgctgacctctcaatctagtctgttcctggaagtaacgacttggccaactgaggcacgctattacacagcctagctggcacagccgctgagcctccaggttccagggtcacaatttctggattcagatcccatctctgctactactgttagctgtatgggctttgggaaatgatttgacctctctgagtcttagtgacttcacccatgaaactggataaatcagggaacctactgtggggttgttatcaacactgaatgaggtactgctcattttcaagttttgctggcaggtgtaaaataataatgaatgttagatagaattaagaactctggttcaggggcagagcaggggctgttcccggagcccttcctctccttcctcactctcccagctcgcttgcaccttggatgggtgctgctagacggtgcagacacccacagccccggcacagttcaaggatatgatcttcgatttctgatgccatcttgtcacagttgactccatagtccttgtaatcatctaaaagagattcgagaaatacaggtatcagccagacacaacgtaggcagtgaagcctgcttgtacctgggactagagtgttcctgtaccatcccttggggtgctgagaaagactgaatttcatctgccctcagtgagattgggaaaagggactccttccctccctcatccctagcccaggctctctcaccgtccgccttcagggctgctgacagcatctccacacacttgtcccggacagagtcccctgtgagatagcagggggccaggagacacatggaagaggcaaacgtgggggtcaaggggctgctaggtgttttggggctctccgcttttgatttgctgctgtttgatctgaggatgacaataagtaacagacatttgacattaagagagtaaagcatttattgagcagcattctagatgtcttgatggatgatctcctataatcctcataacaacctcatgaggtaggtactattttaggcacttgacatggatcatctcatttaatcctcgtgacaaccccatgaggttgatactattctcatccccattcgagagatgcattttaaagtgcatggtagagaaagatgtatctaaaggtgcacttggctcagataacacatcgacgaaccagtagaaacagaattcaaacccaggcagtcggctcttaaccagccactgtgcgttactcattatagaacagtgtaacaccaccaataattatatgcaattgattaggcactgtgctagctgctctctatctatgctctcctaaatgtatgaactgtttattcactcattcactaaatatttattacaaacctattctccaggcgcttgtcaagaacaaaggataatgcagataagtcagcaaagctccttcccttaaggggcttacagtctagtgaatagtgactatctaccaccatttaaaagggctggctttgctagatgccagaactgtgccaggcactttaaaagaattttccaatttaatcttcatagcagtcccaggaggtatactctcatcatctctattttaagacgaggaaataaacccagagaggtacaccactgagatttgcctaaggctatacaccaccaggatttgaatccacatctgtctaattccaacatctatgctctttttattaatttattttattttttgagacagggtctctctctctctctctgtcacccaggctggagtgcagtggtgcagtcatggctcactacagccttgacctcctgggctcaggcaatcctcccaccttagcctccaaggagctgggaccacaggagcacgccatcatgcctggctaatttttacctttttttgcagagatgggatctcaccatgtttcccaggctgatctaaaactcctggactcaagcaatccatctgccttggcctcccaaagtgctgggattacaggtgtgagccaccacacccagccaacacctatgctataatctatgatgtactatctaagaattatctcattcaggttttgtttatatatatgtatatatgtatatatatatatatatatatatatatatatatatccatatgtgcacagacatttagaaggctaactatgtggctcaatctgtcataacaaaatatcagactgggaggcttcactagcagaaatttatttctcatggttctggaggctgggaagcccaagatcaagttgctggccaatttgctttctcatgagggctctctctttgcttgtgaatggcagtcttctcattgtattcacatggtgtctcttctcatagggacactaatcctattggatcagggctccacccttatgacctcatttaaccttaatgaaggccctatccccaaatacagtcacaatggggtttgggatttcaacatatgaattttagggggtcacaaacattcagcccataataccatgttaatagcaattatctctctgaggtggaatgataggagattttcattttcttcgtttgcttatgcctatttgctaaatcttctatacagaatttatctacttttgcgatgtgagaaaccttttttttttttttttgagagggtgtctcactctgtcatccaggctgccaggctggagtgcagtggcacaatcttggctcactgtaacctccacctcccggattcaagtgattctcctgcctcagcctacctagaagctgggattacaggcatgcaccaccacgcccagctaatttttgtatttttagtagagatggggttttgccatgttggccaggctggtcttgaacccctgacttcaggtgatccacctgccttggcctcccaaagtgttgggattacaggcatgagctactgtgcccggccaaaaaaatgcattcttggcagaaatgatggaagtgtagaaggccaaggtttgcatgggcaatgtcaaagggctcaatgcagctggagcgtgagggtgagggagcttgtaagaaggagagggagttggagagaaaggatctaaccagactctggggtttgttaaggatggtaaaacaaaagccaccatttaccactgctctgctgtttattctttttggtaaccctaaaagtcacaaattactgggcccattttacagatgatggaatggagccttgaagaagtgaagtgtgtcaatcatagctcactgcaatctcgaactcctgggctcaaacaatcctcctgcctcagcctcccaagtagctaggactgactacaggcagatgccgccacaccaggctttttttttttttttgtagaaatgggggtctcaatatgttgctcaggctggactcaaactcctggcctcaagtgatccattcgccttggcctcccaatgtgctgagattacaggcatgagccactgtgcctggcaagactttgtgatagttgcacaactccctccctcccaagatgtttttgcactattctttagggtaggagccaggaagtcaggaagtctctgtcttcattcctctgctcttctcacctcctttttcaataacccatcagaatctgccagccagcccctatatctctgttgagaaaaaagtggactcatcagagttgaaaaaattaaggtcccctcctggagtgaaattaagacccactcgagggtcttaccaaactgagcccttgtggaagcgcccagagagctgctgcatttcctcactccaggaggcaccatttacattagtagcttggtacctcctgtaattatacagtgcacagcctgggcagctgcgccaggcagccttggggcctggatccacagctgcttctcatgttcactttcaggctgtggacatgctacttcctttcaggaagaagaggattctggacttctgacaaagtctctcaggcccagggagttgtgtctgagagtgaggctaactgagtagcccaggcttctcaggatcaacaacctggagttaccagagaatcccatccaacatcctgctgggcacagctcagtgtggactctgctggtgacctccctgtcccccacctcttgctgtttggcctgaccttggatctcctctttcaccccagacccctggacctttgggatttttgcattctctagagacttgaggttcctcaaaagtgcctccatgcataccggtgaggtgggctggggatggtaaactctgttcttgtaaggtttacattttgaatttctaaaaattttgtccaaagggattcatttcctagcttttatttatttttaatgcagtttgaaacttactgtcctagattaatctagccttaattctacccgaccctgcctgacaactgggttgcctggcagcatggtggagggacagggaagctgagatccaagcagatttctcctggagtcagattgcagcaggaggtttgggtgaggaaaggctggacagggcgtgaactcgcggggctgttggcatccaaaacggatgttcctgcccccaagcctgatcctggtcacagggttcccacctgaacagtcacaatagccccaaaactggtttccctgtgtcctcttcccccactataatccatttgccaaagagccgccagagggacttttcaaaaattcacagcggatcaagtcactcccctgcctctaaccctccaacacaggggttcccaccccctggggccacggactggtaccagtctgtggcctgttaggaaccgggccacacatcaggaggtgggccctgttgtgaactgcgcatgtgagggatctaggttgcacgctccttacgagaatctaatgcctgatgatcagaggtggaacagtttcgtcttgaaaccatcccctacaaaccctggtccatggaaaaaccgtcttctatgaaaccagtccctggtgccaaaaaggttggggactggtggtgtaacagcttccaattatttttagcataaagtaaaactcctggccgggtgcagtggctcatgcctaaagtcccagcactttggcagatcgaggtgggaggatcactttggtcaggagtttgagaccagcctggccaacatggcgaaacactgtctgtactaaacatataaaaattagctgggtatggtggcgcatgcctgtaatcccagctactcaaaaggctgaggcacaagaatcgcttgaacccgggaggtggaggctgtagtgagctgagatcatgccattgcacatcagcctgagtgaccgagtgagactgtgtttccaaaaaaacaaacaaaaacaaaaccaaaagctcaccacagcctcccagcccctgcacgtcctgcccctacccactttctgatgtaatctcatgccatgctctccgcatggtttacggaaggcctccacagcactgcttctttctgttccttaaacatacccatccctcccactgccgggcctttgcacaggctggtcttccttcctggaatgctcttcctcctccaggtctcagctcgcatgagggaggccttccctcaccacctcagctgaggctgatggtccccgccctgtaattctctagcacatcacctgatttctcgcttttacagcacttatccaagtgtatgattagcttgtttatgtgtttataaacatcgtctgcctccatctccagattacaggctccagagtattgggaccctgtcacgggttcaccactgcattccagctcctgtaacagtgctctaggtggacacttgatacatcattgctaaatggatggataaatgaataaatgaatgaatacatgatgaattgaggaactgaccacagagagatgaaaggcacacccagagggtcccccagggctgaaatgtggaaagaggaaggtcctctttggaaggacagtggccccactctctgggcctaagagagggatctctctctctgggagtacgagagggatctctctcaaagccagcctctgtcaactcccaggacccaggcaacgccatctcctgcagctgggatggtgtctcgctgacctgtgcgtgccattgcacattctcaacagctatgactcaccacaggaaaactgtcaggggagcctgcagcatgctgctttgaaggagccccaacgaatgacagtaataatggtggtcgtttttgaaacgactgcactgagttggtttacttattaagaacctagtctctggagccaaactcccaggttcacagcctgagaccaacactttgtagctatgtgaccttgggtgagttccttaacccctaggtgcctcagtttttttcacacgtaaaatcggaataataatagtacccatcttatggggcagatgaaagcaactaagtgacaaagtattaggcagtttacatagataaccaggtttcatatgagtattattacaaagtattatgtatttattgagcatttacatggtttgggaacagtgctgggtatttcattacctcatttaatcctcacaatgaccttgaaaggggttcataattgtctccattttacagatcagtagactgaagctcagagagctgaactgaattatccatccaagttactgccccaagttatccatccaactagcaaagggtatagtcagaccacgaacctgcctgtcgcccttccaaattcttttcaacacatcaactgtgtctttaaaagagaggtttccagagtcctcctacctgagcaagactaggctgtttggagcatttcttcccaccttcctggcagggcacacccagccctggtcccgcctccccggttaggagctggctggctggctggaattcgtgtctgggcagcatttcaggcagccacactcattttgctttcaatgcacacgcctgggaactgagccaaactgcagagagggcatcatcggccggggtgggaggttggatttatcaacagcttccttctgctccccggatgtgcccgcaccgcaccagtccttagaaaatcctcctgccccaggtctgagtagaggcatctggaggccgggcccgctgcttctgtgcgccacctcgagggcatttcagttactgcatcagcgagcatgctctgcaaatggcaaatcattctgatagccaggtaaaaggacaactgagaacagtcaactttctcccctgtcaacatggtatcctccgtggtctgcttcctggtactccagctacagttcccagagcatcgtgctcactcccacttccacacctttgggtgtgccatttctttctgcttgaaatgactctcctgactcgcctcccaaactcctcctattgactttccattctcagctcaaatactttctcttccacgaagcctcctttgacttttatagtcatattgagacatgcttcctatgttcccacggtgttttatacctacccctttctaaaaacatgcattttggtgtctgcctctgcactcatggttagccctaagaagggagaggtgatgagtttcaacctttgcctggccttacaggtcaaaaatgggtgagctacaaatatgttttgtctccctattgtgtcttagaaaaatgtgaatatgttgctgatactgaaaactgggagttttggccaggcgcggtggctcacacctgtaatcccagcactttgggtggttgaggcaggaggatttcttgagcccaggagttcgagaccagcctgggcaacaaagtgagactctgtctctacaaaaaaaaaattttttttaagttagctgggtgtggtggtgtgcacctgtggtcctagctacacgggaggctggagcaggaggattgcttgagcccaggaggttgaggctgcagtgagccctgtttataccactgcactccagcctgggtgagatcctgtctcagaaaaggtggtgtcggggagttccatatgaaaatctaggtgtctggcttttctttaaaaaattggaagacatggcaccctggacctgcatttccccaaagcaacaatcagctgcagtggggtagtggctgcccccttcagacaggcacatactttctagtttgccatgatctccactagtcaccccgtgtatgcatgtgctcttgatccccagagaatgttgaatttgcaaggaagtgctcaatagatgtgcttgccaaatcaatgaatggatgaaagaacggaagagaaaaatgaaatagagaagtaaatcatgcaggaaacagtctgggtaggagacaaattaatgagatttgctgcctggcacggtggctcacacctgtaataccagcactttggggggccgaagagggtggatcacaaggtcaagagatcgagaccatcctggccaacatggtaaaaccccgtctctactaaaaatacaaaaaattaggtgggcatggtggcacatgcctgtagtcccagctactttggaggctgaggcaggagaatcacttgaatccgggagatggaagttgcactgagccgagatcgtgccactgcactccagcctggcaacagagcgagacttcatctcaaaaaaaaaaaaaaattaatgagacttccttgtgtcccttttggtttcctaccctcagtactgaaccagcaggaaatggcacagcttctggaaggacaaacagattctgtttgactgaccttcagagaaagaatgcattaggggagggagccaggagatttcaagaccatgaagacaaagtcaggagaggagtctggaggctcaaatccttacatgaatgtcgagtgttttgattacagcatcaaacctagaatgtcattagtgaccagtgtttcatctggggataggatgacgcttcattatccaggaaagtccttcactctccggggcacttggcatctctggttcctgccacgaaatgtcaggagtatccccctccttctcaccttacccctactttggcccaagtcatagtgacaaccataaacgcctccacacatttctaaatgacccctgctgagatccactggtctagaaccaggatgacactggaaccaccatttctaggcctgacccacatcagacattgctaattgactacagaactttttctacagcctcagactccctctccaatcagcactccagatagcttccatgcatcagctggagctggctgccatgttggaggtgtgcaatacagcctaggcccgttgaatcttcataaaaccttaaacaacctaatttttgtgtctctaattttctttccaatggcaatcttactgatacattaggcttaaaataattctgcagctctcacacctactctcccagaggccaacacccttatcatcccaccaaggtgccccaaaacccaatgtggcccatggaccctaatcgttctccttgatctgctgcttggccacttcctggcctggcctgctctccttggccctgtttctcctgctctgacctctgaccactctcttggaccacacttcacacccactcctttatccacaatctttccttggtgccctcatccaggttcttcagatgtcagttacacactaatgactctacaatttttgttttgttttgttttgttgtgttgtgttttgttttgttttgagatggagtctcgttccatcccccagactggagtgcaatggcgcaatctcagctcatggcaacctccgcctcccgggttcaagtgattcttttgcctcagcctcctgccaccacgcccactaactgttgtatttttagtgcagacggggttttgccatgttggccaggctggtctcgaactcctggcttcaagtgatctgcccgcctcggcctcctaaagtgctgggattaccggcatgagccaccgcacctggccttgactctgcaatttatatttccagctgagactttcttcctgagttgtagcctcatataatccaactgcatatttgacttctccaactgaatgactaacacacgcctcaaatccaacacatcgagacctgaactctggattttccaccccaagcctgatttgcataagcacagtcttccccatgccaattcatggcaactccatccttgcagatgctcaagtgaaaaatcttggactcatccctgactcctctgtttctctcattcctcacatccaatctgtcaggaagttctgtcagctttcctgtcaagatatatccggaaaccaccccttcaccccacttccaccattacctccctgatccaagccaccatgatatcttgcctgaattaccgcaacagcctcctggctggtgttgctgttccttcattcctggcacagcagccagagccatcctgataaatttggtgacatcattcccgccctcagtaccctccaatagctccagctttactcattcccccaaccctccccttcgcttaaactgctccagccctcagccacttcactgttccttgactctgccaggcacacccccacctcagggcacttggcttggaatgaccccagtatctgcttggctaaatccctctttcaagcttttgcctaacgatcacttcctcgatgaggacttttctgacaactccatgaatatccttccccgatcctcttccctctcctcttttgatttccacaggacttgtcaccttctgaactttacctgtctccccctacttagaataaaggcccccatcactgcagggatttttgtctcttttgtgcatgtctgtatccctggcacctaggatagttcttgacacataataggccctcaataaatatttgatgactaaatgacttgatgatttatgctaattttgggtagacatcctagccagttcagcccaaatccagagagagcccattccaggtataggctttctttctttttctttcttttcttttcttttttgttttgttttgtttgttttgtttttgagatggggtctcactctgttgcccaggttggattgcagtggcgcgatctcggctcactgcaacctctgcctcctgggttcaagcgattctcctgcctcagcctcccgagtagctgggattacaggtgcccaccaccatgcctggctaatttttgtatttttagtagaggcggggttttgccatgttggccaggctggtctcaaactcctgacctcaagtgatccgcctgcctcggccttccaaagtgctgggattacaggcatgagccactgtgcccagcctaggtatcggctttcaagacctctgtccccactgggttcaatcggaccttgagactggtcccctgacagtgatggggcaacagcaaccagtcagccaccccagggaaggagccacacccctgattcgggggcacacttgctaaatggatggatgaatgaataaatgaatgaatacatgatgaattgaagaattgaccacagagagatcaaaggcacatccagagggtcccccagggctgaaatgtggaaagactgtgtgggtcttagaatacgggggcaacataatgtaggaggtttcttccttccctcctttcctctgccttgggcttcctccataaaaacagagaaggggacacaggctgaataggacactgggatggagaaagctgtggtttcctttacctttccaccgatggtctttttggagaggaggaggcagaagacttggagtccacagagtctctcctgaaagaagaaaattggcaaggagactgctttgtagactagcatcagtactgacaggaaggtggggagaaagcatcctgggaaaaggccagctggcttgaggctaaggaagcccacccgggccacagctacttgggagagggagctccaggcggtgccggctggtcatgaccttcacctaccctccatcaagtgaaccaatacaagggaaggaagtcgatatctgccaagggcctaacacatgccatgtatgtgacatgggttgtgttgctcattatttacaactattctcagcaggtccctgtcctcctggctgtcaggcaggccttagctaactggagtccacagagactggattcctggagttgtctgtactcatctggaaccagagaaacagagaaatcagcttcagcctccccggcaggcactttaggaggaggagaggagaaacacatgggccttggggatagaagagctgagttaaaatagcaatcaaaaaagcaggagacaaaattagatgcggactgtgcctaaagtcacgcaagaaaaccaatgcataggaggaaaagcagatctaaagaaaatatactcaaatgctaaccactgttacagctagggtgatgggattaaaggtgattttttcccaatttttccaaaatgcattcagctacattatttttatgatatataatatagttattccttttactggttttaaaaaatcaatctgtttgttaattgcaaaccccactccccatctcacttaccctgccttccttttaattccatagcacgtgtcaccttctagcatactacataattgactttttttctttgagacagagtctcactctgtcacccaggctggagtgcagtggtgctatctcggcggctcactgcgacctccacctcctgggttcaagtgactctcctgcctcagcctcctgggtagctgggacttacaggcgtgtgccaccatgcctagctaatttttatattcttagtagagagggggtttcaccatgttggccaggctggtctcaaactcctgacatcaggtgatctgcccacctcggcctcccaaagtgttgggattacaggtgtgagccactgtgtctggccaatttacttatttatatttaattatatttattgtccgacaccccatgtaaattccacaagagcagcatttggtgggttttggtcactgtggtgaacattgtctgtgctcagcccagtttcccttgggtgctcactctctcagtgcctctggacccaagagctgcctcctgcaagctccccagggcctctgtctgagggagttcttccccacagctaggctggctggaagtgctggtcactaattaatgaccccaggaacagccctccaccagacacatgggagaggggaagagaggtcctcattcacatgcccctgcactcccacaacaggccctgggagttcttctgtggggcttctccctagtgcaccttggggatagacaatgcaagcaggaaccataagctggaattcctacagtgggagaggggagagaagacacgagactccaccctggagaaccactttctgactcttcctcattgcttttctttttagaataaatcagaaatactccgcagttattgcaaatgactgttatgaaaactgttcaggaacataaaaaaatgcttagaatacaatagcaagataaataaaaaggtgacatattagtcgatactagagctagagcatcaggaaaagtctaaagattagaccgtaagaaaatagaaaccagctgggcgcagtggctcacacctgtaatcccagcactttgggaggccaaagtgggcagatcacttgagtcaggagttcaaaaccagcctggccaacatggtgaaaccccatctctactaaaaatacaaaaattagccgggcatggtggtgtgcacgtgtaatcccagctactcggaggctgaggcagaggaatcacttgaacctgggagatggtggttccagtgagctgagattgtgccactgcactccagcctaggcaacagagggagactccatctcaaaagaaaagaaaagaaagaaaatagaaaccatgtttcaaagacctgtattacaggtacttcatcagtttgtaaggcatgagtccaaaacagctagcagtttggttcttgaaagatccctgaattgtatgcagttacttggacaagtgggttaggaccttatcatgagacagatggaaggaaatactccagcacaatattttctctagcaacaaatgagatgtggtgatcaggggacaggaaagtgtaccaaatgggtgatgtctgtcaagatgacatggcacagaatatcagcattctagccaggccctggagatgtggcacatcagtgaaaaaggggtctggaatttatgtttatttttatttatttattttgagatggagtctcaatctgtcacccaggctggagtgcaggggcaccatcttggctcactgcaacctccatcccctgggttcaagagattcccatgcctcagcctcccgagtagctgggattacaggcacgcgccaccattcccggctaattttttgtatttttagtagagatggggttttgccatgttggccaggctggtctcgaacttctgacctcaagtgatctgcctgccttggcctcccaaagtgctgggattacaagcatgagtcactgcacccagccagaggtctcgaatttatgcagaagaaaaagtagactatggtgaatacacggataaaaataatgggaggcgacaagcaacaacaatcatagtgaggcagaaatttaaaaataaatatgcattcattcaccccaagaaaagtaacaggcaaggcaagggttaaaaagaaaagaacaggttttcctctgcctagcaagctcacttcaaggacagttataagataatgctgtttgggaaaccaaggccaaaggaatgggctccagacacccctcccctccagagcaaggttgaaggaaaaaaagagagaaagacaaattcctttactattactcctttccctgacttcttaagcatgactatgttttacaaatgtctgtatttagccagttcttgtttttctttcaatgcagctacaaggctgccagctatgcaaggccacaagttatgctatgctatagattatgtgacctatcatatgattaactgcttttgttttgcttctgtaagcctgcttgtaaaaaccccgctctgtctttgctaaaatgctcagctgtttagatacgaatccactgagccggtgcataccttaaataaacaaccctcctgctctcctattggtctctctggtcctcagtttcctgcaatgatagctgatagtaggatatttctgagtgaccagacaaaggagaaggcatagaatgggtgattcttcttcggccattgtttgctacagtctcatttccaaatcacgtataatctttatagttcctaaggacaaaaattcaaatactgttttatatttaaaaaaataatttgcacccatagtcccagctactcaggaggctgaggtgagaggatcacttgagcctaggagttgcaggctgcagtgagctgtgattgcgccactgcactccagcctgggcaacatggtgagactctgtctcaaaaaaaaaaaaaaaaaaaatggccgggcatggtggctcacacctgtaatcccagcactttgggaggctgaggtgggcggatcacttgaggtcaggagttcgagaccagcctgagcaacatggagaaaccccttctctactaaaaaaaaaatacaaaaattagctgggcatggaggcacatgcctgtaatcccagctactcgggaggctgaggcagaagaatcacttgaacctgggaggcggaggttgctgtgagctgagatcgtgccattgcactccagcctgggcaacaagagtgaaactccatctcaaaaaaaaaaaaattgtacagtctgcctaaaggaatggaaaaattatgtatgtagttaaaccaggcctgggagaggagaggaagaaaaataaaagctgcttaatttgtctgatgtgcacaaatatttcccatgcttattctaagtttcactaatgtggttacagtgtttgtataatgaattatcattaagaaaactaaaaaggaaggaaattaattaactgagctgaaataggacccccgacaactggcttctcccagcagaatgaggagatacctctccattttctgctcagcaccagcgacagcttcatttctgagccccatggctgtgaaaagtgagtgggcataacaatttagtgtcccaggaaaatgtatagtgcatttcaaattttattaacaaaatataaatataaatgtacatatgaatgttctttttttctttttttttagactgagtctcactcctcacccaggctggagtgcagtagtgcgatctcggctcactgcaacctcctcctcccaggctcaagtgatcctcccacctcagcctcccaagtggctgagaacacaggtgcacgccaccacgcccggctaatttttttttacttttaatagagatagggtttcgccattggtctctaactcctgagctcaagtaatccacctgcctccacctcccaaagtgctgggattacaagcatgagccactttgcccagcccatatgtatgttctttttgttttaaagacagaatctcgctctgtcatccaggctggagtgcagtggggtgatcttggctcactgcaacctcagcctcccaaattcaagcgatcctcctgcctcagcctcccaagtagctgggattacaggtacccactaccatgcccagctaatatttgtatttttagtagagacagggtttcaccatgtaggccaggctggtcttgaactcctgacctcaagtgatctgcccgccttggcctcccaaagtgctgggattaagggcgtgagccactgagcctggcctggcctgtatgttcttaaaaaactacaaagatatacattaaaatgttaacaatggttatttctgttattttcttcttgtgcttgattttctaaactttttacactaaacacaccttgctactgaaatgaatacatttatgtacatgaaaaggttacaaaatagtatacagagtgtaattcaattttattaaaacaaataggtattttatacctatttataggtagtaatgcataggaatagtctagcaggatgtatatatatatatatatatatataaattttatatgtatatatacacacaattatatgtgagtgcttgtttctagataataaatgatattttattttactttattttattttattttttgagacagagtctcattctgtagcacaggctggcgtgcagtggcacgctctcagctcactgaaacctccgcctcctgggtcccggttcaaacaattctcctcctcagcctcccaagtagctggaattacaggcatgtaccaccatgcccagctaatttttgtatatttggtagagatggggtttcaccatgttggccaggctggtctcgaactcctgacctcatgatctgcccgcctcagcctcccaaagtgctaggattataggcatgagccaccgtgcctggcccttatcttttgttttgttttgttttgtttttaagacggagtctagttctgtcgcccaggctggagtgcagtggcacgatcttggctcactgacacttctgcctcctgggttcaagtgatttcctgcctcagtctcctgagtagctgggattacggggcacccgccaacaggcccagctaatttttgtatttttagtagagacagggtttcactgggttggccaggcttgtcttgaactcctgaccttgtgatccacctgcctcagcctcccaaagtgctgaaattacaagcatgagacactgcacccggcctattttcttatttatttgtatttttaaaactttctacaatgagcaagtaattatctgtattataaaaaatacaaaatcgctaaactaagacaactaaaatataattaaagactattacaaataaaacattttatttttaagaagaaagaacggagaaaatgatgtctgtgtttcaggccataatactgagtctcagagaagaaggccataagtgacaagttcagcccagaacctggctttctgctttttcattgttacctctcctacacctgttgttctcatacaggcctttaaaagaaatccctttactgttcttttttttttttttttttttttttttttaaacagagtctcactctgttgtccacgcttgagtgcagtggcgggatctcagctcactgcaacctctgctcccgggttcaagtgattctcccgcctcagcctcctgagtggctgggactacaggcgtgcaccactacccctggttaatttttgtatttttagtagagacggggtttcaccatcttggccaggctggtctcgaactcctgacctcaggtgatccacccacctcggcctcccaaagcgctgggattacaggcatgggccactgcgcccagcctctttactgttcattcagtggggcttggggatggagcaaacaaaaacaaaaactgcatgtgttcaggctgccacttttacctggatgcctacactccccatgtgacagattagtcccaaatcccatttggtccctccccagtagttcagcctctagtccttcaacttcatctcataagagctctcctgctcctggtccttcatttgccaaggttctcataaccacacaggtgctccagacatggccagaccagccagggcatgaacaggaggtaatccacagggcaggggaccatgctgctacaaatgggctagcagtattcagtaaatgttcactccgtgctaggcactgtggagatggtcagggattccccgagccaaacttctaacccctttgggaaaagaaaacacactcgtgtgaaaagttagatgccaattagggtttttccaagtaggatacacttgcaaaatgagcaatggaaaggaacagaacatagaaaatgtgacaaaaccatttcacaggcattaccttttaaaaagcaggctattaaaattggggatgactatagaaaacaagtcagagaacagaaagaaaagccatacactaactcatcaagagtgattgtctttgggtggtgggaatgtgggtgatttttttttctacttttctacattttcctttttttttttttttttttttgtgagacggagtttcgctcttattgcccaggctggagtgcaatggtgcaatcttggctcactgcaacctccgacttccaggttcaagtgattctcctgcctcagcctcccgagtagctgggattacaggcatgtgccaccacacccagctaattttgtatttttagtagagatgggatttctccatgttggtcaggctggtctcgaactcccaacctcaagtgatccgcccacctcggcctcccaaagtgctgggattacaggggtgagataccgtacccggccttccattattttctacaacagatttttatcactcttatttgtttagtttttaaaagcactattattattttttgtttcaaaagcagtacaggatcattgtgaaaaaacccaacaattcagatttaaaatttttattgtataatacagaaagtagagatccttttaatttataatatatgtcttggtttttgtttgtttgtttttgagacaggttcttgctctgttgctcaggctggagtgcagtggcgcaatctcagctcactgcaacctccatctcccgggcacaagcgattctcccacctcagcctccagagtagttaggattacaggtgtgcgctaccatgcctggctaatttttgtattttttgtagaggcggagttttgccatgttgcccaggcttgtctcaaactcgtgggctcaagtgatcctcccgcctcagcctcccaaagtgctgggattacatgtgtgagccactgcgccaggtgcaatgaatcttataagtggctattgcctttgctagcatcttggaatctttgtctttgggactgttacaagattcgggatgtgaggcttatacccgctgtggtcttgtttccccgcacctaggctgttgcctgggtgggccagagaagagctctagactgccgtgcggtctcctatgggaactctctgtagagaaatgctggaggccctcccgcagacgcactctttcctgtccctgcatccttctaggcaaagccagtgccatttatgtcctatttgggtcttgtgagtctaacatctggttgagccaaagaagacccccagagggggcactgcaggagataataccaatatcttcctccccaggatgaaaggtttaaatgagataatatacactgagttgctgtcagaggacgtgacaagtgtcagctcccttctctccatcccaaaaaagaatacctggttttggggtcttctcgttttttccttggtggagaaaggcctgcttctggcttccagtctgaacactcaagccctttttccttcttctttgccttttctctttcctctcctttttctccttttgggggtccaggggagtctgaaaacaaaagggtggcattgtccctcagctaagctctgtctcagcagaacccagcatgacttagtggggagagagcaaagggcagggacgaggacagctgcacacacactcccaacacacacacaaacacatttacacacaaatgcacaaacaacaggaacgtgtgtacaaatacacagtctcacatggggacattaatacattggcaaacacatctctgcacatattaagacaaatgtgtgcatgtagacatgtactatatagacaaatgcatgagagcacaaacacgtaagtggcacatgtacacaaaactcacaagtctacaaatcttgcacttgtgtacacaaacattggcagtcccccactagctacctcccggatccagaggccatctgtcactgattaagtcactcaacagacatacactgagtgctggctatgagccaggcccagtcctgtcccaagtgctaggagaaaaacagggctcaagacaaccttgtcctctctcacctagcagccgcttccagtttttgataaggactttggccaaggacaccacctccttgtctgagcagtgcttgcggaccccattaacagcaactccaatcctggttgtctgcaaagtgagagggttaaggcataatctgggaatggatacacaggaatggctgccatcattggcagatcctgccccagctctaccaccacctccccttccaacctggacccccagagtcctagccctgactcctggctgaggtcagaaccccactactgtaactaaggccctgctctgcacgaggccgagggcccagggctaagcctgacatggaggatatctgtagctttggtgaaacctgaacctagggttgggggtggcacttggctgactgtcaggacccctcccattcccaaccctctagtgtctatttttttgagatggagtctcgctatgttgcccaggctggagtgcagtggtgcaatctcagctcactgcaacctccacctcccaggttcaagcgattctcgtgcctcagcctcctgagtagctgggattataggtgtgcatcatcgtgcccagctaatttttgtatctttagtagaaacggggtttcaccatgttggccaggctggtctcgaactcctgacctcaggtgatctgcctgcctcggcctcccaaagtgatgggattacaggtatgagccaccgtggccagctcactctagtgtctttgagctccagtttcaactgagacagcagctccggctatgagaccttgcatctgtctgtgctgatttttcagggccaggagcttttggtaaatctggggactttaagggctacacagggattttaaatgggggcttttccctctccctggatcattggcctcttggatcccacaggcccagggccttgggaattggggtattcaagaaaagcgaaccagtcttgctccaaggcccagaggtcccctacacctagaagataccctctccgcccccgagatgcccctgtgtccccctcagtccctccctgggaggtctccacctcaagatcccctccccacaggcccccctcagaaattcctcccagactccaccttcccccaccaggggtctttccctcccccaccagctctccccccaggcactgtcccaaggcttcccacccccgccccacctgtagtagctggatggacatctggcagctgtgcagcttcttcagaaggtccagggccccttcctgtgggaggccacaaggtgaggactggggcctgggtcctgaccaggcttctctgactattgtgtggtcttggtacagagagcaggaggatacagacagacatgtggccgaaggacaggcaaggggcagaaggaaggagagagacgagaaacaatctgtcctaggtggtgctctaacttcatcccccgccacctgctgggttcaaaccctctgagccaggctcctgacctccagcctttggttctgctgtgcctctccccaggaatgccctcccccttccccatctttcctcccaaatgaattccttcctggcttattgttgctcgtgtgcctgtagcgtccttcccttacctccccactgtgaacttcgcagggtgaggactgggagccttttaaaaaacaaaacagaacagtttggccagcatggtggctcacacctataattccggcactttgggaggctgaggtgggcgggtcacttgaggccaggagttcaagaccagcctggccaacatggtgaagccccatctctattaaaatacaaaaattagccaggcgtggtggcgcatgcctgtaatcccagttactcaggaggctgaggcaggaaaatcgcttgagcccaggagatggaggttacagtgagccaagatcacaccactgcactccagcctgggtgacagagcgagactccaactcgaacaaaacaaaacaaacaaaaaacagcttttttgaggtataattcacatacaataactgcacactttgcagtgtaaaatttgataagtttcaacatacgtgtacacccatggaaccctcaccacaatcaagataaaagcacagccaccagccccaaaagcttcttcctgtcccctttctaatccatccctccccatccccaatcctaaacaaccacaattctgccttctgttactatagttgaccttgtatctttaaggattttatgtaaagagtatgtagggcaaaaacccttttttatctggcttatttcggcataatgattttggagactcatccatgttgtctcgtggatcagtagttcctttttattactgagtggtttccactgtatgtatgtaccacagtttgcctggcattttttgagacaagatctcactctgttgcccaggctggagcgcagtggcacaatcacagttcactgcagcttcgactttccaggctcaggtgatcctcccacctcagcctcccgaatagctgggaccacaggtatgcaccaccacatctggctaattttttgcattgtttcgtagagatagggttttgccatgttgcccaagctggtctcaaacttctggcctcaagtgatcctcctgcctcggcctcccaaagtgctgggattacaggcgtgagccaccacacccagtctaccacaatgttttaaattcattcaccggttgatgggacttatggataggttccagtttggggctgctagaaataaagcttctaggtacattcatttcaagtctttgtgtgaacaggtactttaacttctctcgggtaaagagaaccgttctaatctctgagaacttagggctcagcagagagtccagtgctccctgagtggatgaacttgtgcagaactaaagcagaaagaaggcaggaggcagaaaaaggcttaggtttgaaaatctgtgagctgccaggccctggacaccctccgacccatttcagccttctcctttcccccagccccttcctagaagccatacctgcctgctgtcctgagatcagttccctggggagcaccaggggacggtgtcctgtatgttcctatccttggcccacagttcatggttccagctgccaatccccaccctggcaggacctggaccatgtcctaagagctgccctctgtcagtccttagcctccctgagaacttgggttcacagtaggttttcagaagcgtgacctgcagatgtgtgtgtatgtgaacttgggggtacacaactccaagtgtaacattaattaaaggcttgctatgtactaggcactcttctaagttttttacctgtattatctcatttaacattcacaatggccctatcgggtaggtcctgtgtattattcccattcttacagaattattatcctgtgttcaccaaagagcaatccaagaaagagagaggttaaataattttctcaaggtcacatgctttataaggagccaagttgggattcaaactcagtccttttgggctctaaccactatacaaattgtgttagcatgggcgcagatctgtctagacatacacaatcatggaatatcaacatgggtaagtgcagtggtgtgctggccaacgtttaacaaccagttctcaaggaaaaaaaaaaaactgacctgtagtgtttgccaatttctgtggtgtaaacactcatcccatggccaatttcaagctaccaacatgctgtcactgaactgaaggaagttttgggaggagacgtacactaccataccattatataatatttccactgtacagataacaatagaagtaaattatctctgaccatacatgacagtacaatgtagtaaaacaatcaggaagtgattattttggaggattccttacctttgtttttaatataatttatttattgtaagcagataatgtagttttttgaaacaattgctgtgtttaaccaccaggttgcaaaattcctgaaaacgcaacaatctgtgttaagccagttccagctctccactgggtgtatgcctcgtgtgtcacagctgtataactgggtcatattggaggagaatagccatgagcctggattgtagctggataaacaaagccttgtgcaaatgttgctgggtgtatctctctgaacatacaaatgggttctgtagccagtagtatctctggtctaagtgtgcagctgtgaatatgcagctccgggcacagctgtgtctatttggctttgtgggatgacgcctgtgttataagatctgaatgtataaatgtggctgtttgctaagtctgtagcattgcatgtctgggtgtagctgtgctgcgtgcatacgtgtgtggctgtctttgtgtatcattctataactataatggtcaatgtgggtcatatgggtcagtatgcttgtcatgttggtgtcagtagccgtgtctcatacgcagttaggttcagttgcttgtttaactactgtgttgtggccacatgttatagctatgtgtgtgtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaaccactgctgggcgggtccactttcactcccagagcaggccccacctttctcggccagacgcccagagctccatgcccacccagacactgccgagagcccaggcgcagacgtggctgtaaactggctccatgctgcagggaccctgcggccagacttgcatcttttcaggggacagctctgggcacttccacaggaatccatctccaaaagacaccatttcctcttcccatttcacagaagaggaaactcgaggtccagaaagggaaggttgagtggcttttgcctagggccataaaaggagtgagggggaggccagggcaggtcccgtcctcttcagccagagctctatcccaagcagcctgcctctcctccggtctctaggcgtccccaccctacccctcttacccaggggcccagaatttctttcctggcccaagcttgggggtcagtaaggagctgggctgggataacccgtctatttgaactggaatttggctcagaatccctggctgcgctctgccaaccccagctgagaaaatgctcccccaagacttgtggctcagttgtactgaggattgtggaggagtctggaacggggagtgcatggaggttgggagtgtcaggtgagaagctcccagcactctgcaggtttgtgctgtatctttctgtgttggacctggctgcgtagaagcaggtcttgttcgccagttcttagcaagcacaggtctgagtcctactaagggctttacatctctgtctcatctctccaatcctcaccgctgccagcagagacaagaatccagtgacatcccttctccagaggcagataatctcatctctttcttacagatgaagaaactgaggctctggcctttatatggacaccaactcatgactgcccagtgtccactctagggctccctgccacttcatggttccagtgacccttccctgggccttggctactcttcctggctctaaaacttcccttagtgtctcttcctttcccaggctcctaagtgtcctggaaatgcaggtggctgcagcacatggctacggatggtgggaggaagaggaccctggaacaggaacgggaggtgggaagggcatgctcaccaggctccctttttttccctcccagggtgagcgcaggccctccaggacccaaggccaaatttgctctggccaggcgaccagtcggccgccagccccaggcaaagatcacggggaagatcaaacattaacttccagctgggtctgcgctctggccaggaccctccggtagggctgtcagccctgctcccaacctcccgccgagcccgctcctccctccgccctcgccctcgctgcacaggcctccagcccggcccccttcccccgccccgcgggcccccgcacctgttcggcccccgcccgtccgggccgcaccccaaggccaaggaaagggaaaattgccaaaagaaccgctcctgacgcaccaagcggtggggtcgcaggatccacggccttttacttctctcccgcagacccactccggggtgcagggatgcagctcagtacccccgtcagcccaagtttctctgccacttctcgggccacccggatttgccccccgccccgcccccgccatcgccgccgctccccgggctttgcacacgccaagccctgggactcccaaagtcctttcccacgtccagctctcttcgcccgctttcctgggccctgcactagctgcccagggtgaaccctacacgtccaaagggacgtgcacaagtcgcgcctccgggacccgcacgatccccctggcgtcctgggccacgcacacgcccacctcgaggtgctcagcaagggtccccaaggggccttgggccctgcaccagccgctcctccctcgggtccccgagtcccgtacgcgcccccatggcgccccgccagtacgtccccaccccggaatccggggcttgcccgcgcctcccgggggcgggggccgtggcccaaactctgcagcctcaccgtgttcttcctggccaccatcttctccagctttttggcgatcctcagcagctcctcttcctggcccatgttggcccgcgacgcccggcggggcgaggggcacaggggcagcagtagggcctcgggggcaggaggcgcgaaggcggagggcgcgcaacccgcgcgggccccaaacacacacgacacacacgcccggcgggggcg

SEQ ID NO: 1540 - DNA, 368558 bp, Homo sapiens
ttccataaaggcagtgtttttttaattttaaaattctgcatctgaaaacacagtatgacagaaagcatctatatacacctgcagtgtttttggtatgatacagtatttaatacatccactgttttctgcaaaaaatgttgctttgtcagacagaaacaaactcccctagacaaaaaaatacagctaaggcacaattttgttgttgttgttgttctgcaaaataaaaagacagaaaaggtgcaaaaaagggcaggtaatgcagtcatttctgagactcacattctacctcaaggaaaagcattcagatgattggaactttgattactggtcaatttcagatagttcaatatctcttaaaatactcctttaaataaatagcaaaatatctacatatttcagcgtgtgccatttgaattctttttttaaaactttatttacagattttttttaaaatcaacacattacaaaatatttctgtacagttttatgcatattatgatctataacaaaatagttatttttaaaaactatatcaccacatgtctttgaaaacaatgaaggggacggtaataacttagagtgaggcctctaaaacaaatacccaaacaaatgctattgacaacataatatttaaaaaaaaaaaaggcaaaaggactacaaagacaattgcgcacaattccagtgaatttcctatgaaaaccctggggttgtctttggcctccatcagcactggagcaatggaagggtaaagaatagagtctgaaggtagggaaagggtgattcctttgagaacactacccatctgctgggaatatttagtgctatcactttccaggcaggaaggacgaagagataaatggagaacgtctcctgatttacccttgaatgaagtacatataaagtcacccagtcttgggggcaggggaggtctgcaaagccttttcaagcactctgccgataattaagccagcccattacagcagcagtatgctctgagagagtgcttcaggagttggctgagctttagatgagcacccaagccttcattttgcccataggaaaaatataagaacatttttcttaaagacgacatttgtaagcaattcctatagcatctgccaactacagattggcagccccttccttaggaggctgccacagaagcttcacgatgctgtcttctctgatgttggtggagatgggagggaaaggatggatggtcagcttcccaaaaataatgttaaggccacatttcaaaaaggagaaacctaaggcttttgttttgttttgttttgtttttgaaggagggatgggagaagcaagttggaggaacatgagggatggagtagatgacgttagggagggggatgacaaggtgcagaacccgctttctggtggtatctgtaggcagaggcagttggaatattcccagccaagtggagagggaagagaggtcactttctccctgcatacgcctggtaagaccagagccaaagacaacgtgaggggtagacacaggtggcgcaagaaagccctcctccatcttaagagggtcctatacagtatcttgtttgcaaggtaaacacaaaacaaaacaaaacaaaacaaaaaaacttctaagagagccagagaggaagagagagaggagagagagaatttgcatagatcatacattcagctcaagcagatttggacaactttgttcccccctcccaggtaaacttctcagcagacacaatgaggtagcgcctgtggtagacccatgggcaaagtaaggtaactgaggcagaagcaaacaggacatcccgtgagccagcacagctctatgtggtttccaaagaggcttccagggatgggacaagatggctgtgtcaacacttgggatttggagagagcctggctgtttcacaccctacctcctcctcctcctagactgtctttgccatttcggcctggtttgatggagtcccacaagctgtagccccaggcagatgtggacctctgcatatctaaggggcagcagtccagatctccagattctattccttcttcccttcagcacaatcttgggaccaggagagctgaatgatccatcccccctctgtggaatggtctcttgaggagtggaatgacttagcaagaggtccccattccgagttcaacatgggctgttatttttgccctgacctgatgctggcttttttcctcttctaccagggcaatgcataatctcactttaaaccacctctccagagagcagaggttgctggcagtgtacacgtggaacagtggaatttttctttgcccactatctgttaaaaaaaacaaaaacaaacaaacaaacaacccgacgttgaaaaatcagattttttccattaaatctggatttccggcttcccttccaaattggaagattccactacactgtgcttacatttttacaaacaatgacaggttggggctgagtagcagctgctcattctgggtaggtcacgtgcatgccagtaagaccacagtccccatccttgcccccaccatgcccttttgcctcacaccaaccatttcacgcatctatgctagtattctgggccccataaacatttgtaacccctaccacagtgtgtggctttgatcctgcaggtctagcttgctgtctttaaagtggagtgtgttaacagctgtttctagaatgtacacctctccacccctagatgtacccctccacctgaatgtacacctctccacccctcgatactgctgggaagctggtgctccaaatcctcagtgaacttggttgtgaaaggactctttattcacaccccactgccagtagctactgccctgctctctgcatctttttggcagaaagcttaaggttctagccagtgtcttctgtgttatctgcaaactagagaaccagagggaaacatggtcttcagacaccctacttgtgcccagagtagaagcaattgcagtgagtgagagatgggggcaggtcctgtggttctgctcatcctctctaaactccatttgcgttttagaagttaaacccacaatgagaaatgaagccggaaggactcatgatctcaccaggaaagccttttttttcccctgcaaagggagaaagcagcgcgcttctcacaacacggggaccttgggaattgctcactgcctccttggagacacactgctttacgtgtggaccgggaagtgaagtgggatgtgggaaggctggctgtctcctgagctcaatttctgcctgaatgtcactcggtgggtgggaaactataaggagtgccgcagcctaaagaatgcttccttctccacaaaccaataccccaaggcccacctgtcagccttcctgagtttccagggacctcgtcactggctcagctcacagctgcaggctgtaataggtttccagagaccacagccctatgcttttgaaatcttccacagcccaagctccaggctgtctgaccaatggcctccaacaaataaataaatcattctcaggcaggttaaaaaaattattttccctgggaaaacatcctcttttctcaaatcatgctgggctttgtttgggattttccttaaaaaaaaaaacaaaacacaaaaacacaacaaatgtaatatctgcaaccttattctctggtctattaattaataacatcagagaagggagaggaataccctgtgtgacttctcagctccccgaattagttgtggtgaggaagaaatgaagccatgggaaaaagggaagggtccccagagtcagccagctctgccatttctccacttgttccaggataaaaacaaaaaaaggcagacatgttagtgggtgcaggaggggccccatcttgaagtctgcaggttcacattatgcacagggacttgccactgctgagtccccaaagccactgcaaataacgctgcgaacacaaagcactggtggcccagcaaggagggtgaaagggaagctcccaaagtggcttcggcagccccagggaaaccctggccagaggcagaggccgggggcagaaagaggatgtggcacccagcgcgtggccaccatagagtctgtaaaagagatcataggggctttctgagaaaagtaccctgagatccctggaatcgctgttgagaatggctatctcccggactctgctgcctggatctgacgaccctcctcctaagatggatctctctcaaaggagcctgtttccctctgttaaggtcgcatgaatgcccataattagatgggccatgggaaggcaaccacggagcaagcaggaatggcccaaactctctgcagctagcacattccccacaaactctctgcagctagcacattccccactcaccctccacgttttctgcctgtcacctccttgtgcctgtgacggggggtgagtagggggaggatgggaggctcaggaattccaatactcttggaatccgagggagagtgaggctgacactctgcataaggaaaaaaacaaggctccaacggtccccaaggcaccccactcaaagccagtggaagatgcgggttggagctttctttgcgtggtgttcgatgcccctgctttactctgaggatgaggaggatggggggtagacgcagagaaagagaaaccgagagagagagagacaccagggggtgggaaaagatgggaaaaggggccttttgtgaataaaggcagcttcagttagtaaggtaacataattgacaagctgcaaaaacagcacctactaattagtcatcgactaaaacatgtaaataataaatatctaaagtgtcccttctctacgtcctccattgccaacaggacaccctgccttgcgaggcttgggatggggcaacacatctggctaggattaggacaagtcacacaaagcgaagggcagccccttcaaacccacgctggagagaagtgtcaggactggctctccatgggaagggcagatggctaccaggggtgagacctttttccaagggaatcccatcattcaggggaggtgggattacaggagcaagggaggcctcctgcgaagagctctcctggtgaacagggatgacactccagggggctcgtggcaaggaaaccttttgggtttctggtaactcaacacttaaatcatactgttttttgttgtttaaataaccttcccatttttatgttgcatgtcccgttgagcctgtggccgaagggcatgaaattaaaaaccaaatctgaaatgctatttcctggacgggaaaagtctggttcatgtggtttggtcactcccaacagcaccggtgtgcaattgacgaaggttttgtgtgtctgacctcagaacggaagggctctggcaggggatgggtgctgctgtgctgtctagctcaggagttttgctccaagcattgctttgtgagtttcatcgcgttgccttgtgagtttcatggtcatggctgtcaaagttcccattttcaaggatcaaagaaggtcatggtcttgagtctggtgctcacaaacatcatcctatttctgctactttgtgtggcagccttgagggaaggaggcccagacccctggacaggtggcagttgcacttgtggctggaccttggccatgccacatcaaaaggctttcccacttacctagttactaaggagaatagttcaacccaaggagggctgctgagaggctcagagctctcctaaggctgcagcctccatgggaaagggcccacgaccatgactttcaaggctggcaccagagtcccccagccaagagaagcagaaaaatgaaccaaagggcagggctggagtttgaacccatggttggtctgggcagtgcttgtcaaactggcatttgcagagcccttgggttctgaagaggtaccgtaggagataccctgggcaaggggaccgcccagagggctgagctttgggagggaacctcgcacttgtcagcttcaaccagagcagcttggatttcgtcagcaccctgaacctccacttatgactgtgctccgtaaacgaagttctgctgctcgaaagaaaagtctgaaaatcacacgtctggggtcaggggtgggtcactggaaggggaagacaaggaacctgtaggacttgaggatcaaccagaagaggtgagacagtcacagtgcagggactgagccatcccacccgcagcttgccaaaggcaggttgttggctgatcctgctttgacctgctgaccttccctttccatcattctatggccaggagagacccattcacagagggcctcccccagggtgggaggccggggttcaggccccacaacccctctggctgctttcccgttgagatcctgctgtggcccactcctcgtgcccagtgctacctgagccggccatcaggtttgactgcccccagctccgacttggggtcagggctgaaggagctccaggccgtctggctgcaggtctgcatgaccgggcaggctgtggggcccgtggcacagatgtccatggcagtccacatcccgcccaccaacgagtccagccatccctccagcgctgtgcccgtggaggctgcgttcctccgtgcctgttccacctgggcggggttgatgggcaggctgaggacggggtttaggctctggaagctctgctccatgtaggcattgcggaggggcccattgtgcagcttcagtgcctcctctgaaagccaaagggaacaatttcaggatcagaagagccaccaataggatgcctattcatacttaccctgtgcctggtgctgcactgggtgccatgcatcgcctcatttaattcacatgacaatctcatgaggaagttcttttagcagtcccatttcacagctgagaaaactgagcccgtaaggacagagcccactttgtacagggcacggtgcatgcctttattcattcaacacatgtttatagcgcatctttgatagtgcagacactgattcagccaatatatatttttaagcacctacattgtgccaggcattcagtcaacacatatttactaaacacccatgatctgcaaggcactgtctcatttgataaagacatattaagtacctattaggtaccaggatctattctaggtggtggagcaaaccagataggaaggttaagatccagtggagggagaacaacaacaaagaaataagtagataaataaggttatttcaggcagtgataagtgtcatgaaggcaaaaaaacagggtattgagacaagagggttggcaaactgcagtccttgggccaaatgtggcccaccacttgtgtttgtaaataaagttttattggaacatggctgtgcccatttatttgcatattgtctgtggctgcttttgtgctaccagagctgagtatttgagacagactgtattttacccaacaagctgaaaatatatctagccctttacagaaaaattttgctgactcctgggttggagagtgacagtgacctgtacccaggtctgtttgggaagtccagatctcagctgccgagcgtccaccttgtactctgcgtaagttggatttctgcttcctagaagcctaagggtgcatgaactgaccacagaacaatcactctgaaagcatgaagcttggacccgggtgaggtggggtgggaggtcaaactagctctcataacagtgctgccttgctgggcccctcctatgtgccagtcactttgtgaagcacttcatacaagagcccaggtactgcagtcatgctgtctggttttgcagccccacgtccaacataccaggtgtgtgacttctgacctccatgccttgtacctcagtttcttcatcaataaaatgggtaaagtactaatgccttccttctcactttgtgaggcttaagtgtgctgactcatataaagtatttacaaatgacacctggcatatactaagtgctgggaaaagcttagctagtgatatggtttggccgtgtccccacccaaatctcaccttgaattgtagctcccagaatccccacgtgttgtgggagggacctggtgggaagtaattgaatcatgatgagtttttgccatgttgttcttgtgatagtgaataagtaagtctcatgagatctgatggttttttaaaggggagtgtccttgcacaggcgctctggcctgccaccgtgtaagatgtgcctttgcttctcctttgccttccatcatgatggtgaggcctccctgaccattgaaactgtgagtccattaaacttcttacttttataaattacccagcctcaggtcattattagcagcatgagaacagacaaatacagctaggattattactgttggtattagtccataatcctcacacacctaaaaaactagggggctggttttatcattcctactttacagatggggaaagagaggcagctggagttagagacagatctggggttaaatccaggaccgactgactccaaaggcagtgcttatcactcaccctgatactctactgctcaaggccatcaccaaggtctgatttttcactcatgcaaaaattcaaacaattgggccaggcacgatggcttacacctgtaatcctagcgctttgtgaggctgaggcaggtggatcacctgaggtcaggagttcgagaccagcctggccaacatggtgaaaccccgtctctactaaaaatacaaaaataagccgggcgtgatggctgatgcctgtaatcccaggtactcgggagggtgaggcaggagaatcgtttgaacctgggaggcggaggtttcattgagccgagatcacaccattgcactccagcctggtcgatagagtgagacttcatctcaaaaaaaaattttaaaaattgcaacctcaggcataaatgggttaaacagtaacatgtacgtaagagtgactactactactacctcccagggctgcacgatgaggaatcaggaagtatagcaatttggggtgaaggaaagaagctaaacacttctattatttctaatagatgctatttctaatattttgaagacgttcacattcattgcttgttttattgctcagtagaagcacatatatatttttaaaaaggctggccaatgagtctggtgagttgcgctttaccaaatcaggctttgcgagagctgagatagctaggattacaagaaaccttccaagataatgcagtgttcagaagacagtgcttcctgtttgcctgacagcagctgccaccaccaaaggcacccaggacagcctggatattaacaagtgtccagagcaggcaagaagaaggaagaaagaccatatgctaacccttctaaaagcagtgagaatagtagatgaattcaaaatttgccttgactaacacagacaagatcgccactccttcaattcccaatgccccaggaagcaaaagggttgggttctgtggtttggatgggcacaagtgggaggaaggaggtgagcagtcattgagcacatactctgtctcgcaaggggtttagcaaagctgctttctcccacggtagttaggagccacagtgtttggaagtctggtcctaacccatctttctctaatacagggtagggtgggcagcttcagccccacctgccaggagaacagagcctgctgtctttggtgcgggccctaatttctctatcagagccccttagtgcctctattctgcagagtgagaaagtggagaatgaggagataccgaaactgacaaaaggcaggacattcaaagggaaaagagcagctaacaaacctgcgaacgctgggagccaaatattgtggttgatgcaaaaaaacccttatgagaaatgaggttaatgtgggaaacgctattacaatattagcttgcgatgctcgtctctataattaaattttcctcaattccacctcatcggatttcttgcgattaccagggacgcatcaatagaaaattactcttgatgaatcattttacaaattgcattgctcccacctttgtgttcactgtcattcattggaacatcgctaacaaatacaattaccaaggacaggagggctgctctcggtgggggtaaaatgactcctgggtcatcctgggcatgtgtagggagagccctgccttccttagaaaccctagaagaaaacactggaaaaatcaggaccccatgaatggcccccaggctactccactggcgtgggggtgtgttcaggagcactgcttcattctgaccaacaggtgtacctgaagcagcgaagacacagccatttactcccctctcctccatgtctggcattagacatcgttagagatggtaaagatgtgaactagatcaagaaggaacctaagacctctaagggggtgggattgggcctggtcagctctggaggggctgtcttttgcctggttcatggggaagaaggagcaggcttccagctcaagaaaacatgaggtctctgtctttctgcttgctctgcacaaagacagcagaagctgagcgtttacttcgagactcctatgatagaggattgattgattctttttttgagacggagtctcgctcttgttgccaggctggagtgcaatggcatgatctcagctcactgcaacctccacctcctgggttcaagcaattctcctgcctcagcctcccgagtagctgggatcacaggcacacgtcaccacacccggctaattttgtatttttagtagagacggggtttctccacgttggtcaggctggtcttgaactcccgagctcaggtgatccgcccacctcagcctcccaaagtgctgggattacaggcgtgagccaccgtgtctggcctatttatttattgttttggagatgatagagtctcgctctgtcacccaggctggagtgcagtggtgtgatcttggctcactgcaacctccacctcccaggttcaagcgattctcatgcctcagcctcctgagtagctgggatttcaggcacccgtcaccatgcctggctaattttttgtacttttaggagagacagggtttcaccacattggccaggctggtcttgaactcctgaccttgagtaatccgtccacctcagcctcccaaagtgctgggatttcaggcgtgagccactgcaccaggccatgatagtggtttttgtccacggttcttggctcagaactcctgtaacccttcttacagtcttttcttacaatgttgggcactttaggactcagcaaatagaatctctctctcgctctggcctcctcctgtcccccttctcctgcctaatgccagagtctaatcagattgtgggtgataggactctcattccagagagggccctgacacactccctggaggaaggaattactgcacagagaggccaaggagaatctgaacagacagggcttgctgagttaggtcagaccctttttgtccaatcacattttgacacagttgtcatgcttcagtcatgggtaaccaatgaagtcttcataaaaggcccaaaggacagggttcaaggagcttctggagagctgaatacatggtagcatcttcacaggaaggtgaggaagaactcatccacctgccgggacggtgggcaccccaatgccatggggacagactcatccacctgccaggagggtggtgcaccccaatgccatggggacagattcatccacctgctaggagggtgggcatccctatgccatggggacagactcatccacctgccgggagggtggtgcaccccaatgccatggggacagattcatccacctgttgggagggtgggcaccccaatgccatggggacagaagctcctgcactcaggactcctctggaccttgccctctgtatagcttcatttggctgtttatctgcatcctttaaaatatctttcataacaaaccaatagacataagtgtttccctgagttctgtgagctgctctagcagagtaattgagcccaaagagggggttgtgggaaccccagtttgaaaccatttggtcagaagttccaaaggcccagacttgtgattagcgggcagaagggggtggtcttatggcactgagccctcactctgtggtgtctgatgctacctctggggtggagagtgttggaactgaattgggggacacccagctggtgtctgctgcagaactgattgcttgcttgctgacggggaaaatttccccatgtattttgctgtcacagaaatcttctgtgttgatcatggcagtgtgagagcagaggaaaagtggtttgagagtttttcccaaacaactccctttgctaggactcaaggcacctcctccccatgctgtgtccccatccccttgcatcattggctaaaaggcacccaatccagaactcttcaaagctaagaggctgtaatgcatttctggcttttgagtttgtgatctgttagagatggacatgaataattccaaatatagagagacccagaaatcctgtttctacgagtttgtgttatggatgtaactgcatgggaacatacaatttttttttcttttttgtttttgttgttgttttttgagacagagtctcgctttgtcacccaggctggagtgcagtggcgtgatctcagttcactgcaagctccgcttcccgggttcacgccattctcctgcctcagcctcccgagtagctgggactacaggcacccaccaccatgcccagctaattttttgtatttttagtagagacagggtttcactgtgttagccaggatggtctcgatctcctgacatcgtgatccacccgcctcggcctcccagtgtgctgggattacaggtgtgaccaccgcacccggctgggcacatacaattttatgtttaagactcttccttgttggggctgggtgtggtgggtggctcacgcctgtaatcccagctctttgggtggccaaggtgggagggttggtttagatccaggagtttgagaccagccaggacaacacagaccacacaaccacaaaaatagttaaaaaaaaaaaaaaaaaaaaaaaaagccgggcatggtggcacactcgtgtagtttcagctacttaggaggctgaggtgagagaattacttgagcccaggagctcgaggctgcagtgagctatgattgcatgactgcactccagcctaggcaaaagagcctgacctaaattcttttttttttttttgagacagaacctcgctctgtcacccaactggagtgcagtggcatgatttcggttcactgcaacctccgcctcacaggttcaaacgattctcgtgcctcagcctcccaagtagctgggactatagacgccggccaccacactcggctaatttttgtatttttagtagatggggtttcaccatgttggccaggctggtcaggctggtctcgaactcctggtgtcaagtgatccgcctgccttggcctcccaaagtgctgggattacacgtgtaaaccatggcacccagccaacctctgttatattaaaaaaaaaaaaaaaaaaaaaaaaagacttttccttgcactattatcagtaacatcatcatcatcagcagcaacaacagaaacttatgtgtccaccaataggggaacagatagattgtggttccttaacccagtggaatatcatgtagctggtagctttatatatactgacttagaaagtaaaaaaaaaaaaaaaaaagcaatcttacagtacacaatgtattatttcatttttaaaaaatagcaaaggttttgtgatttatggtgtgtattatgtttatgctttacaagtatggaaaaacttctaaaaggattcacaccagactgttggcagtggtttctctagaggtaggatttgagcagggagaaagactttccccttaataaaaggaggtgaaaaggggcgggggaaatagaagtataaaagtaaaccctttcaatggacaaagaaaaaagtcaggcaggataggaactgacatcccagtccctgttctccatggggatggaaaccctgacctgaatttcatgttaatttcatgtttcatttcctaacagctgcctttgacatacgactcctgaaataagatattgttgactttgcctgtttttgaacttgacataaatacatcataattatgatttatctgtgatatttccccctcaacactatgttttagggactcatccaagccaacacatgcccatgctttactgctattcacggctgcatagtactccattgtatgaacagccagccaattgtttctcctttccagtgtcaggcaatcagaccgtttctggttttgtgctattaagaataattctcatgtgagcatttctgcacatgtctctagggcctataccttggggtcagacgtctgtggtagggtgtgtgtatgttcagctttactaggagatactaaaacattttctaaactcgtcttagcacttcaccctcccactagcactgcatgaatgcctattgctctcagccttagtaacacaggttcttatctgtcacgcatttcccaatatgatgggtgtgaagtggaacctctctttgctttcaattttcatttctcccatttttaatgaggctgaacatgtttttgcgtgtgtgaggggccattcatgttctctcctccatttttttcctctcttttatagcagggttggtggtctttttttttgtaaagagccagatagtatctttggctttgtgggccatgcagtctctgtcacaactattcagttctgccactgtagctctaaagcagaagcaggcaacatgtacatgaatgagcatggtgactgtgttccaataaaactttatttacaaaaacaggtagtgggctggattggccaacttctgatgaatagcatttctttataaattctgaacatgagtactttaaaaaaatgtagcaaatatcttctactattatgtggttcatcttttccacctagtgtatcatatttttgatgaacagaatttcctgttttgatttttttaaaatagtaaacaagatttgctgatccttaatacctgcctgggtttatttcccatcttgtcttcaatatgatctaggctttctggaagttgaatgggggagcgtctaacaaatagctacctaatacctagacagatgacatcatctccgtgtgcaggtaggacattagatggtttctctagggaaacacagagaaaagtattgagagcaaggagtgctgttctgtgaggccgctgcttaccctatgtctgagcagtgctgcctaccaacaccaaagaccctcaaggtccccagggaaggagtatttctcccacatagacactgggagtacttaccaggtttgatgggctgcctgttcgagaaggtcagaggcgcaacgaggaatttggtctctgcaactggcacccagtggtggagaattttcactgtccagaccccaggcctcaggggcaagttcaaagggggcttgtagtgtgtgaattcggcagtggactcaatgaggatgtcgtaggtggctgcgatgacattgacgggatccacccaaatgacggtcacggtcacattaggtcccttcccccacttctgcatacccaccggctcatccatgggccccagaagacccccaaagttgcggaatagcctctccttggcatcccagtcagtgccgacctgaaacaggggagtgaattctgaagtcactgggcctgaactagggggctaggtctcagaaaggtctaggatcccctttgttagctttcatatacccattttacagatgaagaaactgaggctccaactaagtcacctgctcaaggttgcacagcttgtaagcagaagatctggcatctggactcagtctgaaggatcaaaaggcctgtggtccttttattaaaccaccgggcctcctgtgcctggtgtatggcatgtgctttgaaaagaaaaccacacatgagctgaatgagtgaatgaatgaacgaatgaatgaatgaatgaatgcatgtcttgcttgcaggccattccacagaaacatacaccctgccactcaacaggtacagcgggtttccaattccatccttggttttctaaatcacacacctccacttggtgcaatggttctgaacaagaatagagatcatgtttttacagctgctctatcataagctagagaccctcagcattgcctgtcatctacaggggttcaaataggtttcctaggaagagacagctttggctttcccaaggcacctagatctggactgtaagcatgagagtcatcctgcgatccttccttcctgccagccagctgggggtgtgtgcagctgtgacccacagcaatcctctctggtgggcttccctccttccacttgtgccacctgcaatttcttctatatcctgtagtcagaaaggccttgtaaaatgtcctcttactgctgcccccaggcttcttagtgcactcagagtctgagctcaccccatcctccatctccatgaccccctccccatctttctccaggatgccttgttttagccacctcaatcaaggcaggctcattcccagctcagctttcctgcaccatctgccctgtgtggaatactcctttcttgcacagccagccccttatgtctaaagctgcctcacagagtctttatctgaccaccccccaccccaaatttcaaatggaccttcagtcaatctgtgtcattccctactgctttattttcttcctatcagtggtgataagcactatctcagagttgtatgttgatgtatttattctttatctcctccagctgtaatataagctctgtgtgaacaggggttttacctggctggttccctgctctttcttggtgcctactaccatgcttagtacacagcaggtgctcgagtaatgtttgttgaatgaatgggtgaatggcttgaccaaaaactgaatgaactagggagattcctgacaaggacctttgttgctatttcaaatcaaattaaattaggggtcatctaatttgaaaaaaagatctcccccaggtggattaacttagtggttttgaggacacagcatgtgggcatgttggggcaaataacgggtacagtatgaagcttgcactgcctctgctgtcttcccataattagcatctctaatgtgtgtgtgcacgaaggtcgggtgtggatacacatacccacattctgagatttcctatgtgcaggggaaataggagctgatctagcttctcattgttcttgcaagaggtactatgtcagtccattctttacccagcttacagagcttcactgctaatatttgctgagggattacagtgtgccaggcagacgtgtccattcagttgatactcccaaatccataaaggggagacccttgtcattatctttactttacagatgtggaaactgagtctcagagaagtgagataactcgctatggtcagagggggcagagccagcatgggaacccataaagtccagccccagaggctgcattctcatccactgtgctacatattgccttccattcatgaattcattcactctctcagtcattcattcacccaacacacataaaccaaatccctactgcctaccaggggtggctgccatctgtgtacactcactggcatgtgtcttgctttcagttttcatcaggccagagactaaagattaggactaagaaagcatcctgagagtaacagaggtagttactgctctgatgttcctgtgggggctgccatccctcccagacttatgaaatcttggtatttttctactaccctgtggatcagcagggaccagcaccttctgggaccctccagtgcctagcatagtgcccggaacacagtaggaattaaaaggatactatttattgaaggaataaatgaatgatcaacaggattcagttcaagcttcaaggtcttagaggtttttctaaagaaacccgatttctattttcctgcttacaacccctttcagcaactcttggtttctaagtccagttgctttacctgtcctggagacctttctggtctggctccggcttcacttctgtcatctctatccctctccctcccttccacttgctccttgctccaggccaccctgggttattcccagcacctcatccggaagggctctgtgtttcctcttgatcttctggccatgatccgcctgttctctggaccggtctacctttccccgcatcctccaggccacctcaaacttgtaatctagattttggctcaggcatcacctctactcataagtctttcctggatagaggcaccactgaggtacatatctaagcatttgatcatcatagcttttctcctgacccccacagtactgcatcttttaatttacaggtctctctctctccagatctagaccgtcaactccaagagggcagggactatatatggcatgctcaccaatatgtctctagtgtctgaaacagtgctgaacatagagtaggtgctcaatatatctctatagagatctaaaaataaagatatattgagcacctattgtctattgatcgatcaatgatctatacagattgatcatctacttatgtgtgtttatcatctatctctaccaatctgtcacattaatctgtcaactctattgtaaccattaatcatctatccatctgtttgcctattaacgtatccacccatctgtctgtctgttaatcaatctatgtatcacctgtctatcaatctatcttgaacacatattgaatgagtaggggctgaacacatggacttccctccatgcactagtttccaacagatactaacaaaacagatgaatggccacaaaactactttagggtcatatttaaggaggtgatttttcaccagttaggggaagatgggaaccctccagaacactgcccttggatcctccaaagaaatgaggataaacacttccctgaaatcgagttttaaaaccaagataacctgggcaggagagttctggagcagctgacaaacaacctggatcttgtttttcaaccgaggagcgtgaagggtgaggtgtggggcagcctgagctagggccctgctgctgtcacatcctccaagaccttctcaaggggcctcattgtggaagtccaccaccatccactgcagaatggtcaattacccaaattcaaatacatattcaaattcaagcttaacatactgctccctggcttccaaccaaccaatggctttccattgcgtttatttatttattttttgagtttataatgtgtatgtatatgtatatatttcaataggtttttggggaacaggtggtgtttgcttacatgaataagttctttagtggtgacttctgagattttggtgcacccatcacttgaacagtatacactgcaccccatgtgtagtcttttatcccctatatcccctcccctatatcccccaacccttgcccatgagtccccaaactcactgtatcattcttaagccttgatttcctcatagcttagctccctcttatgagtgagaacatacaacgtttgcttttccattcctgaattacttcatttagaataatggtctccaattccatccaggttgctgcaaataccattgtttcgttcctttttatggctgagtagtattccatggggtatatatatatatatgcgcacacacacacacacacaatttattcactgattgatgggctgcttccattttttttgcaattgtgaattgtgctgctataaacatgcgtgtgcaagaatcttttttgtataatgacttacttttctctggtagatagcccacagtggaattgctggatcaaatggtagaactacttgtagttctttaaggaatctccacattgttttccatagtggttgtcctagtttacagtcccaccaacagcataaaagcgttcccttttcaccacatccatgccaacatctgttattttttggttatggccattcttgcaggagtaaggtggtattgcattgtggttttgatttgcattttcctgatcgttagtgatgttgagcattttttcatatgttcgttggccatttgtatatcttcttttgagaacggtctattcatggccttagcccactttttgatgggattgttttttcttgctgatttgagttccttgtagattctagatattagtcctttgttggatctacagattgcaaagattttctcccactctctgggttgtctgtttactctgctgattatttcttttgccttgcagaaacttttaaaattaagtcctatctacttatctttgtttttgttgcatttgcttttgggttcttggtcattaagtctttgcctaagccagtgtctagaagggtttttccaattttatcttctagaatttgtatggtttcatgtcttagatttaagtctttgatccatcctcagttgattattgtataaggtgagagatgaggattcggttccattcttctacacgtggcttgccaattatttctgcaccatttgttgaatagggtgttcttttcccactttgtttttgtgtgccgtgttgaagatcagtaagtatttggctttatttctgggttctctattctgttccactgttctatatgcctttttttataccagtaccatgctgttctggtgactatggccttatagtatgctttaaggttgggtaatgcaatgcctccagatttgttctttttgcttagtcttgttttggctatgcaggctcttttttagttccatatgaattttaggattgctttttctagttctgtgaagaatgatggtggtattctgatgggaattgcattgaatttgtagattgcttttggcagtatggtcatggtcacaatattgattctacccatccatgagcatgacatttgcttgtgtcatctatgacttcttgcagcagtgttttgcagttttccttgtagaggtctttcacctctccttggtgggtttgggtttgttcttgtttctctagctcattaaggtgtgaccttagattgtctatttgggctctttcagactttttgatgtgggcatttaatgctatgaactttgcacttagcactggctttgctgtatcccagaagtgttgaattcaggagcaagttatttagtttccatgtatttgcatgaatttgggggttccttttggagttaatttccaattttattccactgtggtctgagagagtatgtgctgtaattttgattttcttaaaattgttgagacttgttttgtggcctatcatatggtctatcttggagaatgttccatgtgctgatgaacagcatgtatattctgcagtcgttgggtaaaatgttctgtaagtacctgttaagtccatttgttgtagggtatagcataagtccattgtttctttattgactttctgtcttgatgaactgtgccaatattactgtgttgctgtccatctcatttcttaggtctagtagtattgttttgggagccccagtgttagtgcatgtatatttagattgtggtgttttcctgttggactagtccttttatcattatataatgtccctctttgtcttttttaattgctgttgctttaaagttttgttttgtctggtaagaattgctactcctgctcacttttggtgtccatttgcatggagtatcttttttcacctttttaccttaagttcatgtgagtcctcaggtgccaggcaagtctcttgaagacagcagacacttggttggtgaattcttatccgttctgtatcttttaagtgaagcttttaggccatttacattcaacattagtattgagatgtgaggtactattctattcatcatactatttgttgcctgaataccttggtttgtttcattgtgttgttttgcaggacctgtgagatttatgctttaaagagattctattttggtttattttgaggatttgtttcaagatttacagctccttttagcagttcttgtagtgctggcttggtagtggtgaattatcttagcatttttctgaaaaaactgtatctttcatttatgaagcttagtttcactggatacacgatgcgtggctggtaactgttttgtttaaggaggctaaagacaggacccttctggcttgtagtgtttctgctgtgagaaatctgctgttaatctgatgggttttcctttataggttacctgatgcttttgcctcttaaggttatttcctttgtcttgactttagataacttgatgactatgtgcctaggcatgatctttttgcaatgaatttcccaggtgttctttgaacttcttgtatttagatgtctagatctctagcaaggctggggaagttttcctcaattattccattattcaaacttttagatttctcttcttcctcaggaacgccaattattcttaagtttggttgtttaacatactcccaaacttcgtgaaggctttgttcattttttaaaaattcttttttgtgtttgttggagtgagttaatttgaaagccttgtcttcaagttctgaagttctttcttttactcgtttgattcgattgctgagactttccagtgcattttgcaattttgtaagtgtgtccttcattttcagaagttgtgattgtgttctatttaggctatatttcactggagatttttccattcgtatcctatatctttttttttaagttggacttcacctttctctggtgcctccttaattggcttaatagtcgaacttcttaattgtttttctggtaattcagagatttcttcttgatttgaatccattgctggtgagctagtgtgatcttttggggatgttaaagcaagccaattcacaattccttggctgtcccacagtgcctgcaggggcaatccacctccttcaaaggctctatggattctcttggctttcctggcatgtttctgcagtagttcttggagcaaaagttcatgatgtggggctccatacactgctctgtccatccgagtggaagctgcaagtttgtcttgcctcctatccgccattttccctctatctttccattgcatttaaaatgcaacctgaacatctttcccgggcctgcaagactactccctgaggcctctttcctaccagtttccttctcacttgctgcacccagtacattggtctccctgcaactcgagtactcctagctcattcccagtgcctaagggcctttgtatatgctcttctctctgcttggaatgctccagatctcccgaggactggctcttttacaggctttagctttgcagtgatctccttagaaaagccttcctagatgaatcaatcattctattgaaggttgtccccatcaatgtcctgagtccccagcaatcacatgaatgaagttttctctagaatacctgtcattagctgagctgtttgtttttgtttatctatttgctcactcactggctggctgtctcattggaatgcaattccatgaccacaggggcctggtttgtttggttcaccacaatccctcctgaacctggcacactgtaggcacttggtgactacctgcagaaagaatgagcatcttttatttccaagtcaacagcatgagattcccatgtattggagaaatgtatctgagctgttcagccacctgctgtgagccaggcactgtacaaggccctgggatagtgctaacaccaaggagatcctaaatagcccacagagtggtcctgtagttcttccttgcctttctgttcatttgctactaaaattaagagtttagaaaaaattcaaaatacaagttagggctctctgcatcacatgctgttatttttgccagtgattttgatggttctcactccaagggtaccagacctgtgtagtgaggaccatcccccaaaagcactagccatggagcggccaacatcatttgtcactgccagaagtacccagtcacccaacagcaggctgataaacagggagagcccagacaccaggcattcatctctttaatgggacattaatgttgtcaattggctgctcaggcccctagcacagaatcgaactggggcagtatctaattgccccctgatgccagtaatttatggaatgggctcccttggctgctcacatccagcaaatccactgggagtcttaattgaaaacagtggcttaacaagaaactctcactggtgcctgtttgtcatggggatacatacattcgttaggcagggccacagaagctagagaaggactgtcaaggaaaatataagagggtgggactccccctctccccaacatactcttagcccctcaagatgtaccatagtctacaatcagactcttggtccctaatccagcagtcagaaccattgtgacaaatcacgtccttagcacttagggatgtgaggaaggcagaaaccaggtgctgcagttttgtgtgaataacacgcaccaggcttgatcatgcttccccttccttcctgcaccacgacccaagtacactcattcattcattcaaaagtcttactcagcatctacaaagactacatactgtctgtgtgctggggataccacagtgaagagggagacacagttccagctctcttgtgaacaatcaatgagtgaccagataaagcaacaagataattttagatagtaaatgctaagaaaaagtattaaaatagggaagggttggatggagaatgtagctattgcagcagcttaagtgggtgccggggaaggtttctctgaaggtgtatcatttggatttagatcagaatgatcaaaaacaaagctagctatgtgacccatctgtccatccatccttccttcaatccatcattcatctactcatctaatcatatattcagtgattgatctggtacttcccttgagcgaatccaggtgtgctaaaaactgtggagacaaaaccacaactaagcataggatttgtggccaaagagacctaggttgaattttgagctctcccacttcctagcaatccagaaaatctttggatctctataagcctcagttctccattcggtaaaatgggactaatattactgacattggtttaggagtcatcactggaaaaattcagaggagcagaaattctaccctaaaaaatacaactgtgttccagttggtttgatcctcccctgtttaagatgctggtgccagtgactggggccggagaaccttcttcgggcacagggttagcttatctttagggatctccaagtcctcttctcctccatctccaactagaagtgtcagatagtggagtagaatctggccgagggaaatgcaaaatacaatgaaatgtgacaagacctggcctcttacctcggaaaactgaagcctcccaaagtcactgggtgggcttgcgatcttgaagacttttttcggcatcacccaggtctccagagtctctagtttgctcacagccagattggtagcatgatgcttgatcagaaagccctggaagcggtcagcaaggaagtagaggtgcacagatgctgggtggcccattgggtagtatctgaaaacacaggcgctcatgcattagggcccaaggtgtgtaggatcacagtgaggctccccacccaccaagctagttttgttcctaaagcagtccccattgtgcacaatgcctactgttttccttgcgtcctctgtatctatgatctcaatgactatgaatacttttttcttctgctgattatgaatgaaaaacatgctgactgtaggaaagtacaacaaagaaagtgaaatgactactttccatgcctcttcccatacataatgtccattcacagatattgagtcctctggtgcttggtaccgggcagtgaaaatggtgtgtgaacactcatattgatggatttcccttcggccttatttcctatgcatctatttgcataaatactatttgcataaatactacatagttggcatctatctatcctagctattattctgtcttcattgtatagtatttcctgaggattatcacatctttgaaaagtctctgaagacacgattttgtatgtgttgatgctcggtgtgtttcatcatagttaataccagatttgatagagcaagttctctagcattggatgataactctaattttttgcttctctaaacaatgctgcattcaacatctttgagcaaaacctttcattcgtctctctctctgtttaaatgtctgaggctcttcgtgtctgcagcttaactgtttcagaagtactgatttattctctcacagtccttaccacttacactggttatcatctttaaccatgattgccaatctgagataaacacacatgcacatacatgcaaaagtggtttgttgttttaaaatgcacgtctttgatccacaaaaacttgctggctgaaaagggcagggaagtgaagcagagatgtccggagaaaagggggaagcagatggcaaaaaaggagtacctcggaggagaccagtttggtatatttcctacttgtcagataaatagctgccgcttctgcaatgtgtaaattgcacagctttataaggcgcttgtgggtccttcataatagcatttcacaaatcattgtccctgctcagctaaacgcagccttccctctggtcctgatctggagttttaagtctttatgtccaattataacagttagggaagctgccttcctgtgttcacacatctcctgaaatcattgccttgttactgggatgccttccagggagcatagaaaaaaaaaaaaaaaaaaaaaaaaacttgaacagtcttcagatggtttgttgggcattcaccgttcatgcaaacctgttttaaatctggactttgggagtggaaagtccagcgactgtgctgtcattctaccactgcagcaacatctaggcagggctatcacataaaacctcctgcgatgacagaaatattttatttatttatttttgaggcagagtctcactctgttgcccaggctggagtgcagtggcatgatcttggctcactgcaacctccgcctcctgggttcaagcgattctcctgactcagcctcctgagtagctgggattacaggcatcagccaccatgcccggctaatttttgtatttttagtagagacggggtttcaccatgttggccaggctggtctcaaactcactcctgacctcaagtgatccgcccgcctcggcctcccaaagtgctgggattacaggtgtcagccactgcgccaggccaaaagctttttatttccataggattttggggaacaggtggtgtttggttgcatgagtaagttctttagtgatgatttgtgagactttgggaaagctgtctcccaacccactagcaaagtgtgactgttcagcccttgaaatatggccaatgtgactgaggaactgaattttaaattgtatttagttttagttaatttacactgaagtagccacttgtggctaccgtattggacagcaaagatagtcatgaaagagccagtggtcacctgcattaatgtcccaaatctcccatctcctttatcttatgctttcttccatgtgactttgcaagtttccttgtacccgggaggcagaacctatttttctacctctggaatcttctttggacaacagaaagtggtagaagggctgtcacgtcagttctgagccagggcctcaagatgccttgcacatttctgtttgctttcttgctcttttgaggtcaccatgagagcatgcctgggctagcttgctggagaaggagacatttgaaacagcagagctacgccagttgtcccagctgaagccatcctaggctcaggcaactattcccagccaaggaccacagagccacctcccgacttgcagttggctgcagataggggagcaaggcctgcccatactgggaaaactgtccagctgatctgcgaacttgagcattacatgaatgcatattgtttcaaaacactgatttgggagttgtttgtttcacagtgttatcgtgacaatagacaaagcactgccagtgtgtgttctgtgaggtgggtaaagcaggagaatttgctgttacgggagtcaaaggaagagagtgtttccagaaagcagcagtccaaaaaatttagaagtcaatctttgattacttgcctcccttcaccttctttatattttttgagatggagtctctgtcacccaggctagagtgcagtgtcgtgaaactggctcactgcaacctctgcctcccgggttcaagcagttctccctgactcagcctcccgagtagctgggattacaggtgtcagccatcacacctggccccttccatcctctattctccttacacactgccagaatcccggtcaaagccaccatccttttatacctgggcctctgcaggagcttccttaattgtcaccctctcttacttttgcccactataacctgttcccatagtagccacgtccatcgtccctcacttaaatgccacaagcactttgcttcatgctttcagtaaaatccaaactccttacctggtccacaaagccctaccgctttctctagcccccttttgtttcctgctaccctaatccaccacttccttcctcattgctgcctctgacttgtcactctcacatgactttatcttcattttttgcacagcatttacccttattgatcttatattctggtttacttgtgcttaggtactgtctgtctgcacactagaatgggagggctttgagttcacaggcctggtccgcctggatcaaggctgaattctccgtgcctaacacacaggctgacacacgatagctactcaatcagtacttattgaaggagtgaaaattctagaaggattttctcttgaacctcaagttacatctacagtccctgtaaccaaggagtgagcacaaaagccctctgatgcctcatcctgactgtatttggtatctaagtaatgaaaactgttaatgtctcaaaacagaaaaataatcaagatgccgcacaaccaatcatcatctacaggaatgcaaccgaagtattcgtttggcccaaagctgtttttctttcttatttaaatacgatgagcactaaaaaaaattaggagatttggttggcaactccatctgcattcccacggaatgtactggggttcagctccatggacctccaggttcccatggtcagcccaccctgcagggggcacactgagtgattctagtgcttcgtgcctgccccggagggcatttggggacctgcaataaaatgctgacatccttatttctggatggtagattatatgcaaactttactctgattctctcaacctgccatttcagaaacttctgcaatgcatatgtgttagtttataatgagaaaaaaaaatcaataaacattatttaatgaaaggttatattatagactggaaaggcacaatttgcctaaaatacccagataaaatgagactgttaaagttttcacttgctgtttccccacatgccccggggctaggaatccattctcttctgccttttgggataagggtcttttgtcctgatttattttcaggctcctattcataaatacattggctttgcccacagcaaggcaccacagttccattacaataaaaaacgaggtggataccagaggattcctggctcgaggcaacgtgacggctcacttcattccaaaatgaatactagggagcaaccttcaacaaccctagataaattgggggtgtcttttggaatttcctgtaagatcatttaccttatacattctaggaagcctgcaactgtaattattatggaacgacatttgccttccaagtggcaggcactgcactgtctactggggatacatgcagggattctgcttccagactagcagtgggggggagagagactccctggtgaccttgagccaagataccgcacatactgaaggtgaagtccctgaactactttcagcttgggagacggtgggtgtggggtgagctatcttaataagtgtcatagaggaggtggtccttggatggctttgttgacttgagaaggggtggctgtgcagtgggaggcagtgagcaaagaaaatacagggagagaacaaggaattgttaccatcacacacagcaggttcactgttggctgcatcataatggcaactggcaactaagataccagcaatgacctgaaccctgagcagttagtacatggcaactggcaactaagataccagcaatgacctgaaccctgagcagttagtacataaaatgctgttaaaatgggaataacaaggctgggcgcaatggctcatgcctgtaatctcagcacttagggaggctgaagcgggaggattgcctgaggtcaggagttcgagaccagcctggccaacctggtgaaatcctgtctctactaaaaatacaaaaattagctgggtgtgctggtacatgcctatagtctcagctactcaggaggctgaggcagaagaatcgcttgaacctgggaggtggaggttgcagagatcacatcactgcactccagcttgggcaacagagtaagactctgtctcaaaagagcactgtataactaactcatcaggtagtttttgatgattatctcctttacacttcacaacaccttatgatacaaaaatgatgagtattactcttctcatttcacagatgaggaaaccgaagctcagagagatgaatgacttgcccaaggtcaatagcttgtaagcagagtttaaactgcaggtcctgggttcctaacccacactagtctccctttaaactaaatcagaaactttacggagagagaagccgagggatgtgaggaggtgatgggacagtgtcacagccctgcggaaaccttgctggccagggatgagacaccaggtgggaaacctgcctgtgttttcagagagttagtgaacaatcttcttccccccagccccgtcagagactgacgctaaaaaaaaaagatgctatgttgttaaatgaacaagaaaaagaaggagagtgattagaggcacttctgggaatctatcctaaggaaataatcaaaagagagaatggaaaaaaagggctttctgagaaaagatattcatcagaacattatttacaagggtacattactgacaatggcaacagtgaagggccagattaagcaaactctggaacttctgctcaatggaatactagaggcattaaaaggaatcattatcattgcggaagctactgagcagcgtggagaaatgggggctaatagtataatgccaagggaagaaaacaggatacccaattcttgttgcaattatgtaaatatccaaaatgcatattgcttcagaacaaaagaaagggtacacaacgtgaaagtcttgactggcttagggaaagagatgagaggagaagggattatgttgaattattttcctacctccccctcatcttctagaacactctttcctgaagtgttggcagttagtggtagatgagacaattgtaaggggtggttgagaagtttcaacaatagttctgcctattaattttctttgtgatatttttaggtgtgatgacattatggtgaatgtttttaaaagagttatttttcagagatacattattaaaatattgatggctgaaatgataggatgtctgggattgacttcaaactgatccgggaggaggcggaaggtgggtgaagatgaaaatgaaacaagatcagccccgagttggaaactgccggggctgggtgacgggaacatggggttccactgttctatgttgtacatctttgacattttccatcaaaaaaagttttgtaccttccacttaagacaaatgctacatatgatatggtgacaaaaagcttccttctaaagtatatatatgtagcatgaagaatgagtaaaatcattgggtacataggatatctggtatctgagaaagtaaagcacagcttggattggaaatgccacgcacgctaggagggtggcgttagatgagttttgggcaaaggaagagagaaagcatagggtggcattgcattgcagatccctaaagaggaagaaggacccccactctgtaccctgagcctcccctcctgcttctcagctctcctctctgcatcccatatagggctcaccggcagctgttctccccatccgtgtgcagggacgtctcggcccgtcgaagacccaggcgggcaaaggagtggtacaaggtgagtgtcacgtcgctcaggctgtggatgccgtcaggctcatcgtagacattctcccagtaggagcgcaggcccggggtacctgcagggtagttcccgtacaggtaatagtccagctgcccaatgatttcctgattcaccacggcttcaaacttgcgggcaaagaaggtaggccgggctgtctgctgtactcatgggattaaaaatagaaaagccacatcagcgagtgctgggggttggggggaacctaagggcatatcctgtggttagaagcaaagctctgctggacccgaattagctccgatactttttgcacctctgtgttctcagtttcaacatctgtaaaatgggttataataagggtgtgagttaatctgtgcagaacatctaaagcaatgataggcacttagtaagcatcatttcttagtaagcatcatttagatgtctgttaaataaactaaataattttagatggtaatagctgggatggatctcagacatcatttaggtacaggtcacaggctagtaatctagggcaaataaatacagcctgcagatgtattttagctagccatatttaaaacatgaaagagttcacggaaattcttttggcttctctttaaacagcaatagatctggcaaccccaggcccacactccacatggtaacaactggttaaagctgaagggtggtggctgttcctttagacagcacctaggttcttctgctcactgcagtctccaccatgccctattgcctctttggtatttcagccaacttgcagactcacaagggatcggaatctctgggactttgaaaaattcagattccaggccaggcacacacctgtagtcccagctgctcaggaggctgagacaggagaatcacttgaacctaggaggtggaggttgcagtgagccgagactgccgctgcactccagcctgggtgacagaacaagactctgtctcagagaaaaaggacctactgagtcaatagctctggagtgtagctcaaaaaaaaaaaaaaaaaattcccaggtgattatgattcagtgtttcaggaccactgatagcaaccaaactctcaaggcaacaggcccagagatggtaagggacttagctgagaacacacagcaagtcactatcagagatgggacgaagagtcagggtccagggttaaagaaatactaagcacctgtaagctaccaggtgttatactttatattcagtaaaaggccagacagtaaatatttaaaatagctttgaaaccttcagcttcgcttttatagcataaaagcagccacagacagacaagagactaaataaataggtatggctgtgttccaactaaacttcatttatagaagcaggcagtgggctgactttggcccccagggctagagtttgctgaccccttgtgtagggctgcggagacaaataaaacacaggtctctcccttgaggagcttattattgtctagtgttattattgacctaaagttgggtccagcactgttttcatggtggtagattaatagcagcaacaactactgaccacacacaatacgcagggcaatggacttatgtcattacctctaattttccctgtaacttggcaaggcaggtattatgattcccattttacagatgagaaaactgagctcagagaggcaaagcgatatgtacagactcacaccattgtaagatttgaagcccaaatgcatgactccaaaatccaagccctttctactgtatcactccaggactgaggcaactgagtaaactgggaagccccctgatcgtaagtacccttggtgttattctaaacatctcattgccagtctgcttcaggaaacctctctgtggtggggagcacagcttagcactgtagagagttagaccacctgaattcaaatcctcatttggctaccgtctagctgtgcaggtcaagttactcaaactctctgggcctcagcatccttaaaatgggttactagcatagtgtctagcacatagtgtaggctgctctttgattattatcaccagccccttgttaccaggaacccatctaggggcagaacaaactcctttctctgcctgcgattccgaccatagctggatcttctaacaaacagggcacgttaccatattattctttctctccaagttcttcgcgcaagaactctgagttccttacaggcagcagtgtcttgactctagatcttgggggatattcttaatctctgcttgctgtgaacacatgaggcactccttgtcagaggctacaatgtccccaggatgccgggctaggatacaaatgcttgtgcctgggggagtgcagggctctgggaatcagcacgtggaggttttgtgctctaagtgatgaagattctctgcgattagggcagtgagggacgggtcctctccaaacatgggaattcattgaataggtcaaacaaacattcccctgcaaccctctttcggctcagcatatcctttctgcagggaagatgtgagtttaggcagccccctgtctgccagcttaaggtggctggagctgctgtgtgggaaccttaaggggaatacgaacgacagaaaacctgcagtgtactctgcattcatacaggcacaaaaaccaggaaggcagcagggactgctggaaaaaaaccccacttggaacacccctccatgccttcgtttccttacctgaacaataaaagtgatgtctgccccagtaaagccaatgcccacacagcccggcacagaggagatcaaacacaaacaaacagcatcccgctccacatcaagggcaccttggctgggttatgagcctggcattgtgtccctgccttcctgtgttagtggtttgggaagtagcataccgtctctacacggtggctctagtgacctcagagtgattcgcttaaccattcagtggcactcatatttgtgctctctgctgctaggtgtggggagggctggaggaagaagccaccatgctggcttggagggagcagagcaggaaggggtgcccatcttggggccaagcactctcagggctcatggtaagtggatgagcattccccaccctcctgctctgcccttccccagaactgtaaattgttaggctgcccagagacagctgtaaaggggataatgttctacctcttcttactccttcaagtacacagaacacagtgttttcccacagaacacagtggtttccaaacctggctgctcctcagaaaagtgcaattcattaaaaatacaaattcgtcgatatcactgatgagggtttctcaaccagaggtgctgctaagcatcctacccatgcatgggacagcatgtcccaacagagaatcatccagccacaatggcaagagttctgaggttgaaaagctcagccctagatatatacttaaaagcatattcctgggtacaaatgtaacaaatattttgggagattctgatgaaaagggaataaagagaagatgatatgagtatggcctttggaaagttttttttaacctttctgtgcctcacagttttcatatccctaaaatggaataataatgaaaggtcatttgttgtttttgggttaatgagtcaatgtggttagaacatccctgaagtaagtgctcaataaacactggctattgttgatactgttaactattattaattatcaacagccaggtttgggcaccatgtgataagatgacctgcaggtctggccttggatttctgcagaggtttgttgggaaggcatcacttaggaggctggcagaccatgagaaagtctcacctggaagcggtggaagtcctgcggcttgaagtcattgggggagcagccgcaccagtccacgatgtgcttgtactggcacttgcagcccagcttgcgattccagttggtgatgcgcaggttgttgtccaccatggtgtcgcagtgggggctgttctccaggaccgtatggaagaaggactgcaggggagagagggacccagcctgagacctctcccagcctcccacagatgaactggggtgggaaatggtgaacccttgctctgagttcatgtaagaactggttgtttaaaagaatgtggcatctcatcagaagctgggcggcttcctgtacagcttgcagaactgcaagccaaataaacctcttttctttataaattaccaagcctcagattttccttcatagcaatgcaaaaatgtataacacaactacctgactgtcaagggactcttatgttctctgcatgcatttgaggtcagctgcccatgtggtccaactcagagcgcaggcggatgctctgtccaacagacaaatcaaagggattcaagtctgactgactgactggtgtgctggaatttcacccctggggtagggagaccagattgatggttgcattagacccagggcttcctgcatcgccagacggcaacatagggaagggagtgggtggggctgcttgctgtccatggtactgaaccaggtgccatattttctccctaatcccaggattcttggccaactgctttaagggatctgagaaagaggccatgttggatctgaaaagaaaaactagaggagaaacaatcaatcactggagtacttgagagactgccagagagtgagagaaagatttctataatagacagtcccaggcaaatatatttcctccctgttctctctccctaagggaagctgttggggaatctgtgtctgcccgttacaagttaatgggcacagccttctgatttcttctaaaccagtcctcttgaagtggtctgggagaagggagggaaggcagagatgcaggaggtgggactgaacagagaccctggagtatatgtgcttgtgtgtgctggggccagggaggggcagagaaagcacacacacggagctttggtcaccagtatcgtggtgggcgtcttgattaaaaatagccaaactcccaaacaatctcttctaaatggatgggtgggtaaatgaggctccagccgccaccccctgctgaccttcctgtgacactaaatgacaagcccatgaacctggattttaagcttgaattgcctacaagcccagggaggcatacattctccaacaagcagtgggaagatgtacccaattactgattgccctgtgtcctttcataatgatacagaaattccctgcaatataatggatgaggaggttatcagaattgagagaagaggtgattgatttttgctgaaataggattaaaagctgattacttaacatgtgtgcagaatagtaaaacctggcccagtgatgacaagctcatcatccctctgggtgatgggggcagtcagccctccccggagcttggcactgccccagacacaggtgagagatgtgctgggagtgtggcctgcagaaacacacataacctatgtggtcccgggaaggaacaagggaccgttcatgagaaatgccatagactcaatagaaacggaaccagctctgcactgttctcaagctggattggaaatgagggtgcaatcaacctggaggtcaggaagatgaatctggaatccctcaacccagctctgaccggcaggcagctaagggaatgtcagtgacaatccttcagaactggatcccctccccacttctagatggggctaggactgttttagaatactctggattaatggagtatgacttatgaaaccaacacccttttcttcagggaataatagagcaatgttcaacatgagaaaaggcatgcttggtgtaaaaaggtggtcattacatgattggtcattgtgaaggatgcgtcaaaagttgatgtggcggccgggcatggtggctcatgcctgcaatcccagcactttgagaggctgaggcaggaggaccacttgaggccaggagttcaagaccagcctggccaacatggcaaaaccccatctctactaaaaatacaaaaattagctgggtgtggtggtgggcgcctataatcccagctactcaggaggctgaggcagcagaattgcttgaactctggaggtagaggttgcagtgagcagagactgtgccactgcagtccagcctggatgacagaggaagactgtctcaaaaaaaaaaaaaaaaaaaaaaaaaaaaaaaaagttgatgtgggtgtgtcctgaaagggtcagcatatacagttgtgcaggttacacactacataccttttaggggtgccatcagcattgtggatgtcagaagggttttttaaataacagttttctggaaaatagccataaggttcttgttctaacaaaatctgtgtatcatgtgatttttatgaccaatgaaagccaagtatcttgaggaagagctgccttttctattttgcacaaagacactgtgtggactgccggtggtagcaccgtgtgtctactccacgcagcctctgtgcagactggagggagaccaggcatcctgctaagacagcaaggatgtctgggtgtgtagaggacaatgtaggtggacccagaatctctttgccaaaaattcagcatctgctttgccacaaaggctagaacaagcccctatctttcttgggaaaattttcccagatactcacctcagcaggaagcagggtgtaggagtagaactgtttcatcttggtcaccagatcgtctgtggagaaggtcacatattctacaaacctccggttcagcaggaaccagtccgaaccgccatccacggcaatgccctctgggatccgccgatctcccaggcgccacatgtgagcgtcgcactccaggaagagccgatccaggccctgcttccgaatgaacctgggagggagaaagctgcccttagcccagaggtgtcctgaaagacagaactccagccagagtccaaataaaacaacacaatcatagcgatgatggcaattattgagtgcctgctgtgtgccaggtactgctccagggctctgcgtggagtttatcacttgatccccacaagtgaggcatgtcaccgtatttacccctatgacgcaggtactatttgacccccaactttcatatgagggcactgaggcttagagagcccaggggacttacccagcacagtcagatgacagtgatcatctgctacagctactccttctctagagaactttggcaacaacctccttatgccatagaggtcttggcagtttagtgaatgcagaccatggacccttgtctcagaatagtactcttcaatgcatacaacaaaatatacagggttatgaaacagcgaaaaataaaaatccaccaaagttctgatataaagtaatgcctgtgcttcttgactcacacattatatacaggattacaacatttttaaaatttttattttttgagacagggtcgtgttccgttgcctaggctggagagcactagtgtgatcctagctccccgcagcctcaaactcctgggctcctgtgaccctcctgcctccagctcctgagtagctaggactacaggcatgcatcaccatgtttggctgatttttaaaattatttttgtagagatgggatcttactatgttgcctagactggtcttgaacttctggcttcaggctcccaaagcactgggattacaggcatgcaccgccatgtctggctgctgcttaaatttttttgtagagacagggtctcacgatgttgcttaggctggcgtaaaactcctggcctcaagcaatcctcccaccttggcctctcaaagtgctgggattataggtgtgagctactgcatggggcctggattacaaaatacattttaaaacactgaatgtatggtactacgtgtgtttctttattaatacattaaataacaagatatcatggcaggtctattaaatcctgtaattttttttttttttttttttgagacagggtctcactcggtagctcaggctggagtgcagtggcatgatcttggctcacagtaacctccgcttcctgggttcaagtgattctcctgcctcagcctcctgagtagctgggattacaggcacacaccacctcacccagctaattttttttttttttgtatttttagtagagatggggtttcaccatgttggccaggctggccttgaactcctgacctcaggtgatccacccaccttggcctcacagagtgctggggttataggtgtaagccattgcgcctggcctaactcctgaaattttgaagtagtggtgagcataaatgatatttagaggtatctgcaccaactataatgtgacaggaaaatagatgattcctactggtgaccgagtcagttagttactgctaatactactgtgatttgttacctacctttagctagatttcagttagaattccattaaaaaagatatcattttcttctcatccaaaatcacgaacctcccctgaatttttcccatgaaccctagattaataactcctactgtagtaactatatacatataatcatcttgtttagaattttgcaaggcaggctgggcagagttggcatttcctattttgtagatgcagaaaccaaagctgttcaggtcccagagctggtgacgtgggcatgttgggagggtggacagagctagaaccaaggcttttgggccaaacgctcagtccattagcaattagcattcattgcacacataaccatcattgccattaccatcatcaccattttcattatcatcactgtcactgccaccatcatcatcatctccatcttcattatcagcaccactatcaccattttcacgtattacgtgccaggtactgtgctggcccatggtacaggtcaaggagaagtaaggacgagctctgctcctaaggagctagttatctagatgggagcttacagtctagagttgaactcagggacctttctgctccttcaggctgctggcccttacacacgaccaggactctggatttttcaagcccttatgaataactctattgtatgaatgcttctccacaccaccacagtttccctacacatgtgcctttggtcatggactccgtatgtgctgggaatgattgtcttcttcctctccccttcagtgttccctgagtgaacttcacttcatcgatcagattgcagaccaaaagctactctctcagtccttacagtcttacaacactgtaatttcttccaccatcattgccattaccatcatcacaatttccattatcaccactgtcatcaccaccatcgtcatcatcaccatcatcatcacaatttccattatcaccactgtcatcaccaccatcgtcatcatcaccatcatcatcacaatttccattatcaccactgtcatcaccaccatcgtcatcatcaccatcatcgtcaccaatttcagtatcaccaccatcttcatccccattatcactaccaccatcaccatggcaatgaaaacatatgagcattatcattacaagggctttatatggattatctactttaattctcatgaaaaccccagagacagtacttttattaacccatatttacaggtgtatgaactcagcaacttgccatagcacatttctgtgattctgtgattactgtctaccctttccagtagactacaagcttcatgtgagctagggttgttcttgtttttgctcatcactctgtgcctggcacacagtaagtgcttagcgagtattcacagaatggatagatactgaatccatcaataggcaaatacatgtccagcacctaccacaaccccagccttgtggtgggtacagtgaaagacaggaaacactataaacgacaggctttatcttctaggaactcatagtctgactgggcaaatatgatacaggcacatataaccataggttaaatgagtttcgaggaacttctggaaaaatggggactagggcaagggtgaaaagccagcatgctgtggacttggttggtggtcagggatggcgtcatggatgaggcagggcttgagtcagactaggaggggtgcagggaggagagaaaaatggacattctagacagaaaacagactcatcagagatctggggagcagaccagtttggcttaattgggagattgctctgggcagatgacacagattgaaaaggtcatacatttttaataaagataacatccacacaatgtaaaataacaagagaccaagaaatgattttatgatgaaggggatctaagtgtctcgaggaagagctgccttttctattttccacaaaggcgctgtgtggattgctacaggcagcaccgagtgcctactccatgcaggctccatgcagactggagggggatcaggggctctgctgtaacagcagtggtttaaaattaagcatttaaggtgtacagtttagtggaattagttcattaacaatgttgtccaactgtcacctctgcctggcttcaaaacatttcatcagcccccaaaagaaaaccccatacacattacacagccactccccattcatgctagcccctgataaccatcagtctgtcttctgcctctatggatttaccaattctagatatttcatataaaggcagtcatacaatatatggccttttgtgtctgcatcttttgcttcgcataatgttttccaggttcatccatgctgcagcaggtatcggtgctccatgccttgtttttgcctgctcagcatccatttatgatttttctgggaaccacattttgctttactttggactcatccttaaatctcagtttacttgggtctgtatcctcaccctagcaccagggggtgggaacatgacccaggatggatcagagcatcccatctgtctggcctccataatcaattcagggatgggccagcaatgcaagctgggtctgagactaggtcttggattgttgctggagttagtgagaaggaggggcttttctatgagatttctggcagggaggatgtcagcctagggctgctggtagccatctcatcaccatgaatatagaggttgtctgacaatggagcaaactggaaataggagacagaaagacacagtgccaagcgcttgatgggttcacttgagattctggatctcactgtgcctgaccctctcccagacttgtgtgttatgtgcttaaggcatttttgagatgagattcctcacttgcatttgaaaaagtcctaatacatgcctgaatgatttcaacttaatcacaaccatgatgtgtggggaggttcttaggctccagacagggcaggtagccagggctgtggcacaaaaatgcttcctcttccactgagccagtctgctcagagttctagagctgtctgcatttctgcaacagacctcgttactctgtcttcagactggagttacctgtctcctcgcaggtagcctttattctcactacaacacactttggctctggactttgtgcctcccttccaggtcctaggacagtgcaggtcagctgctcaagaaaagtctactgtgatgaggagacttcagggtttggaagctgaagatggtcctgccctggtagtcacgctgaattccagaaagaattccctctcaccgggcttcccacaaatccactgacattcactcaggggaattacttgaaacctcattagtaaacctacattcttagcatttcttttctgcatgagcagaaaacccacctctagacattggctactatggaagataatgacatagtacacctaagtcatcacaaaatggatgatggtgtaatgaaatggcgatgacggtaacgctggcagggaacagacttaattcggctgaaatgtgcttttcatctgtggggcagtgtggttttacctgtcaccagctgggtgacttcaaaatgttaaggagtcctctctgagtctcagtttctttcttggtaaaatacaaagttggtctagatatgggttgtaaagttagatccctacagggcggtcagacagataatggaagcgtgtgaagcagcctgaatacgaaaaaacaaggactgatgaaattagcagagaagtgaagaacacacattctgaaatgcacttccactcctttaaaataaaaaagcatttctggttgaataaaacatctctctaggatgaatccagcccataagccatcggtccagtcacaataatcctgggttaggtaattcccaaggtactctccagctttgacattctataagtcacattgttatactcaggaaaagggcatggggcaagcaatacatctcatatggatacacgggagcccagagaagactggcaacttttctaaggacacacagaggactcaacacaagggtagaaccaatcaaaagacccagctgtcctatgtcacgggtcttgctctttctctaacacatctttccacatgcaaaatctgagctcattagcaaagccatgttcttgctacagagcagtcctctctgtgtctcagtttcccccttggtaaaatacaaaattgggctaggtctgggttgtgaagttaaatccctataggggtcagacagacaatggaagacagataatccaagctcattagcaaagtcatgttcttgctgggaaggaactcagcgaagattttttgtaatacagtattaacccactgaaatgtaactgagctctaactgggtcatcaaaggaagcccctgagtttaggaaaataaaaccctgccttgactctggctagtgctaattatacaaaaatgtccagtcgatgcacttaaccatgcttgaaactttcaattttagataatttgtattcaaacttacatggttaccagactaaccatgagagacagacagagaagaaatacaggtgagaggactagcaaaatttttctttccagtttttaatttcatgttccattatatgggataatagcatcgtcttgcaattttaatgtgatgtcccggaccataatattcaaatacaatatttatgcagtcatctccaaaatgaaatattcatgggattgggagatgggttgctgtatttatcacattcaaaaactgatatgctgcaaacgcatgctttggttaactaagagtaaatggagacaaccaattccctaggtctcagaaaagtttctggagtcacaggggtgaatggggacttaagtcttggactaggagatggtggcagaggcccagcaacagggtatctaccaggggagaggcatcagctgtttgggcagggatttgcattttttcttccctttctttaccataacttgaaaaggtaaaattggaaggcaaggtaagtcagtgaacacctgagtgactttttataaaatatggctcaccaacaaggggcgcatggctctctcacctgaggcgtgaagcacagatctgtagcaataagccccatatacaaaaggtgaccaatgatacgctcttccttttcatttcccattgagtaggttacctggggcaactggggcaacaggtgacactacagcaaacagacattgggtgatctaggtactaatcctgcctctgcattcacaggctatgagatgtggggctggcttaacctctctgaatgccagtttcctcatctgtaagataagccccatgacacctgtgtcttgacagcctcctgaatcagctgcaaagtgtgatggatgatgcttctcacagggccttgcaaagtgtttagtaagcgctgttcacccaagcaatgaaccgactcaaccatcaatcccttcttacctaaggatgacatccctcccccatgcctggcatcctcaatcctcctttcatgctttgtatttctccacaggacttttcactttctaacacaatatacaagatatttatttagtctgttgtctatttccactcactagatgtaagctgcaagatggcagagatttttgcctatttttgttcactgctgtatccctactgcttacatcagtgcctaccatacaactggtgcttaataaatatttactgaaaaaatgaataaaaagaagggtaacagccacacctgttgggcaatcaggcagtcacagactttcgttaactaggtattggatccttctaacacacatttaacagaaaagaaaattgaagctcagaaaagttatgtaactttcccaaggtcacacagccagaagtcttgaatttaaatgcaggtctagctggatccaatgcaagctcttaactactctgccatctttgatgccctgattcaccatagtcccaccaaaaagatagaaagaacggatctgtgatcttctaatgcttgaaaaagacaatgcccagaaatgagagagaatcaaaagagaagggcttattgttggctttggaagaatctttctgccagacctctggaagatatctgtcttctacctgaggtcaaatatgaaatcatttgcattcagttttacttcctaggctatgaggaaggggcagctcaccttcctgatatttttacctattagcacactaaggaaaaagtcacagctaaatatgatcctattgggacatcccagggaccaaatctactcagctgagcatcaaagtaaatcagacagagggtgggaagaagtcctgattctcccccatgggagaagaagtcagttaaaaaaacatctgtggcttttggaaataatgtcagaaaggtggataacaaagaagtttctcaattcagttaattcactggctacaatcttggtatattcatcaagtatggaattattccagaattaagctgtcccactgtaagttttagaaggaataactctgctcttcaagtttacagcatgtctgagcaagaaggaatcttcacaagcagctaatatagctaatgctacaaattaaaaaaaaaacaacctgagaatgaaagtacaaatgatacatccaaagtcacaatgcctagaaaaaataaaatctcccccttttctgttttcctgtctggtaatctgtcattgaatctagattactccttcagcataagtacaacctaaggattttagttaaaaaataaagtcatggaataaatcatatagacccacaatgcatgaaatcagtcagctatgtgaacaggctcacacatctcttcctaggctctcaggaaagggcagtttagctgcctgagatttttctctactggcacaaagtcacagctaaatattattctattgggatgcagtggcaagattttgagtcctggaatcagattacttggcccaagtcttgtgtcttctactaaccttaggcaactttaatcatatggtactttggtttctcacaggggaaatggtgatcataatagctaattcacagagctggtgtgatgattcaaatgagattgtatacagggagggcttagcacatagtaagggctccataatgtccattacgatgctttatgtttttttcctttatcagggtgaatttctatctgtcctattctctcttctgggatttggtagacaggtacataggacacctccacagctaagaagaaatcctttagtctggcagagcaatgatatttcagcaccaaggacagaagtccttgttttagttgtgcaatagccatgattgtggcatgaaggtgacaagtgtcctggccatccttctaattctgtccaagctctggatgagctcgcgaggattcagctccctgattttgaagtttggcagttcctcagggcccctgctagccatttctctcaggcccacggtaggctgtgccccttctgggcctgagctggagtcaattgttattcctctatcctacagtagctggaagatcaagaatgcttgaggaattcattcctttagcagcactagagagcaccttcgatattccaggctctgctctatgcactgagaaaatggttttaaataaaatggacatcaccccgcccttctctctcttctaggcaagacaaaaagcgtaaataataacagctaccatttattgagcgtatactacattctaggctctgttctatgcacttaatatatattcttctgtttagaattcactgcaaccccatgagggctcattttacaaatgaaggaacagagacacagaaaggttaagtaaatttcccaagacccacacagctggtgagtggcaatgaggggaatcaagccttagtgtcaggctctgcattccacactctagccacaaggttctaataagtaagtagacatcgagaaatatgaaacacaaatataaaattacatgctatataggaacaaatatgggggtaatgatagaaaataaagagacagggacttaattagtggagatcattggggaaggcttcactgaggagcaggtggcatgcaagctcaaagagaaggaatcagtcctctaaggagttatggggaaggcctttatgagtgacagaaaattgaaagtgcaagggccctgtggctgccaaaggaagctacagggaagtcctcagcttcagaacctcacttcataggggccgacttgatctgattggtggaagggacataccacccacaagtccacgtggcttggatatggagggaaactccgcagtcagcacccttagggagtcagtgcagcatggtggttaagcaccctgacttcaggctgggcgtggtggctcacgcctgtaatcccagcactttgggaggccgaggcaggcggatcacttgagctcaagagtttgagaccagcctggacaacatggcgaaaccccatctctactgaaactacaaaaattagctaggcatggtggcacatgcctgtaatcccagctacctgggagactgagacacgagaatcgcttgtaccttgcaggtggaggttggagtgagctgagattgcactccagcctgggtgatggagcgagactctgtctcaaaaagaaaaataaaaagaaccccaactttggagtcactctgcttggcttcaagtctgtctcgccacctatgagctgtgtgttatttaatctttctagcctcagtgtccccatctggaaaatgggcacgatgatgatcgcatttatgtcatggggttgttgtagaaagagtgaatatctgtaaggtgcttaggataatcagtggcacatgtaccagttattattgctgccctgtgtggagaaagctgacttaggtttgacattcaaggatgatgattagttcaatgtcagaaaaggggagctagggaggcagctcagatgccatcccggcctccaataggagaatgctgcctctggcagatggggttcaggccagagaagagagagaaacttctctataccacttctgacctggggctggaatctacctgcctggctttcttatatttcccaaggagggcagaaaaagaagctcaagtagaaatgcagagtcagtggcctgaatcctgaggctggagtacctgggcttggtggctcacattcttcacagggctcacgtcactgaatcagcttgcatcgccaagcgtctaaaggtctgttgagggctaattggttttccacatttcatgtatttttgaaaacattgtttactgccttttttctgattataaaaggaatgcatagccttgatagatggtttggaacataaaaaaatgcaaagaagaaaataaaaatcatactctacctttcagagatgacactgggaatgtacttcccctctagtcttttgtctaacttctttgtgtattgtttggaaagaagaaaagttctaaagatgacctaaaaacacacgctgaggcccagggaggtatgtgtgtgcagttttgtgtgggtgcctacataatgccagactttattttgacgtggctgctataattggattaaataaagtgaacatgcaaacagtcatgaacgcatcggttgggtttaaggaaagcaaaagagaaatgcaatctgctttccctattggagatgagatattaatgatctccttgcatcagtcatggagctacaagttagccagaaacagagctcttctctcaataagcaagctggcaccaaaggccttcccgaatgcggatttgcctggaggaggttcctggccaggctctcgactgatttgccaacttttgtttaaacatttgcttgtttatacatcaaaggaggtttgggtctgatgattagttcaatgtcagaaaaggggagctagggaggcagctcagatgccatcccggcctccaataggagaatgctgcctctggcagatggggttcagaccagagaagagagagaaacttctctataccacttctgacctggggctggaatctacctgcctggctttcttatatttgaaatgatagctgtttctcttactatgctttgccttactttaagcataatacccataaatcatgggttggagtggctaattttataaattgttgtcgatacatataaggtcaatacctaactttcatcacatgcccacttataaagggcccaaaagaatctcccatgtccccagtggacatgagagttattgaacataagagttattgaacatttttgtaacatcttaattatgtgtatattatcatcaagattcttctcatatcaacaacaccatcattatcaccactactaccaccaccattgtgatcatcatcaacttaataggcgcaactaactgtccccaagggcttttccatatattaattcttgcaacaactctatgggattggtatgattatcctcattcccatcttacagatgagaaaactgatacacaggtaactcacgtaacttacccaaggtcacacactgtgagtgggtattagagttggcccgtgaatcttgacagtctggctccagagcctggattcttaactgctatgctatgtgctttatgtagcatcctatacaagaggccccttaatattctgctctaagccaactttattatttttagagacatgatctcgctttgtcacccaggctgcaatgcagtggtgcaagcctcaaactcctggccttaagcgatcctcctacatcagcctcccaggatgctgggattacaggtgtgagccactgtgcccggcctctaagctaactttaaatagcttcaactgttttctttcaatgtagccttattcgaagcataatatccataagtcatggttggagcagctaattttataaatttgttgatacacataagatcaatacctaactttcatagcatgcccacttataaaggacccaaaagaatcccccatgtcctggtggcacataaacacactttgcaaaatgctgaccctaggaagtaggggaaggacctaccctcacccatgcaaaaagataattctatttacattcagcaggattttctttcatctgcacacctcgagagcgtaaacctgcaggtcctctcaaatgcagtcactatggagtaataaaagaacacaggccttaaagtcagacggaaccaggttccatctcagctctgtcgttcactagctgtagggccttgagtaaggtaaagcgactctcaaacctcagctgtattcatttctgaaatggggtaacacctgctaaatgaaggtgaaatgagaaaatgtcctggaatgcgcccagcgtggggccttcctgtggccagtgaggatgctccatctccccaataccatgatcattatttgaattttataaagatggagaaacagaggcatggcctgtcgaagccatttgctgacatcccatggctgtggtatagaagagctggcatttcgacccaggtggctggactccagcatctatgctctggcacttcacacactgtgtcccagggctaacatgggggccctggtgaccctggatgaagtggagaaattagatcaaccagggaaggaaaagtctcagaaaaactccgattttcactttccagctccctggaagaggcctgtccccacacactgagacttgaacaggtttcagagatttgaaaaacttctctgatgctccctgagccaaggccagggacttgtagggatgtttccaaatacctgattattcaggctgagagtaaacatgcggccacctgcttctgcaagccctgctgaggctgcctgggaaaatgacaattgtgctacctgtcttgcaatgtatctagtgactttacttttggaggaaagcaaggagaaacagtgaacacaaccctccccttcatttaataacagaaacaatcaggaccaatttggcagctattagaatactagtttgcctttatgccatctcttcacagtgggagccagaagtccaaattggctgctaaaggttggagatgaagacagaaggtcaacattgctattaggagctacgtggaattaaaaaccgaggcaccccgtggcctattctgtatttcactgcttgcctttgttcatccccatctctctgtctttcaagatctctgcctctgtcacctcctcttttaccagggctggtctggacacatgaaataccagaatgggaagggaatttggagactttctcatgcaacccccttgtttttcaaagggagaaaatgaagtcaagagaagcagagtagctgcctcaaagtcaccagtgcattggaagaaagcaggcctagaacacagagaggcttcatcacgtgagaattatgagcttggactctgtgaacactcacttgggtgtgagtcctccccgctgccctagtgctgtgagtttgagcaagtaacttcatctttttgagtctcagttcccttatctataaaaggaggctaatatattgccaataatccccacccagtgccagaaaattaaacatacacacagaaaaacagaactaatagagagtctgggcctgatgatataatttgcacagcttgatttagccatacctgaagtcagccctaatgttttagttacctgatctggtaatgttctttacccttaagctagtttgagctgggtttctgtcatttcccaccaaaagagttctccctaacacatcaccagtgaaagaacttgagcaagccacgcccagctctggtcacttgggagggaccatggatgatgggctataggtaggcttattcgtgcagcaggtgaggccacagctaacaaagagggaagtggccagtgaatgggacattggcttgttttactattaaattaatgctgaatcactgccctaacttccggtaaatgagaaaatcccagctggggactcacacgcaagagttggaagttgtgagctattctgtcaagaggcctttgggttttagggtcttggagggaggtgtaagaagcatttcctcagcctgagacttctttatgttgtcccaagacatctgggtaccacctgtcaattacggatgcacatcaattatacaaaatgtactcaggcacctagaggcaaaattcaggcccattctccatctatttctttctcctaccagcaacaatttagttctatgcttatcataacaatgacataatcatcaccatcaccatcatcataaacatttactatgccaaatgctgtatatgcagcatctcatttaatcttctcaatgaataaatgagtataggtctattaatattttcaaatattatgaaaccagttcagagaggttaagtcactcgtccaatgcaacacagctagaacacagtagatcagaattccaaaccagaaggtgtaacctcacagtccctgtttttaacttgtgctatactcagttcctagcacagtgcctgacaaatagtgctcagagaataaatcctgactaggctgaaatagttaatactagggtggatgtaattcacacacaagttgatacatttacaatgggctcctttctcgagacacaactttgcacaaatcacctattagctgctacctggagaagaagaagggtttttccttctctacctgagggcgaggaataccaatgtctgagccacttctgacaattaaccacctccatggaatccttgcccagccccactttgctcctgcagctatggggccagaaaaacttgggttcaaattctagcatttaaccagctgtgtgatcttcagaaaaatcaggtaaactccagaagcttgacaaatggggagaataattcttacagctgcattgagtggctgtgaaaacaaatatggatcctatacaaaaagggcccacttagtaggaacacaatacacagtggccatgattcttcttactcatccagccaggcctctgtactcttagtggcctgagcgtagtaaactaatctgtgctaatttacagagcatcttcaagttcgggtgttgcagaaagaggcctcctttttaatgtaaagaaggtaggctgtgagtaggggcaggaacaatccataaatagcagaatgaaatcaaagtttcaatttagaaaaatgatacaacacaaggattctagggttacttttttttttttttctattttgagatggagtctccctctgtcacccaggctggagtgcagtggtacaatctccactcactgcaacctccgactcccaggatcaagcgattctcctgcctcagcctcccaagtagctgggattataggtgtgcaccaccacacccggctaatttttgtatttttagtagaaatggggttttaccatgttggccaggctggcctcgaactccagacctcaggtgatccgcctgcctcaccctcccaaagttctgggattacaggccttgagtcacggcacctggccagattacttctttaaagctcaggagacggagctacctgcttgcttttgttcctcccatgctgtggataactgggtaaactgtcacagagccagccaaaatgacactcccaccaacaacagcagtgaagatttaaagcagagattacaaacagagatgtggtcgggggccaggttggggaacggggacaggcaaggaccgagcgacctaagatccaggaaataactgccatgagaaaattcaggcacagacttaatggaccttcagattttttaagactggctagaaatctggattttcataggaaatactgctgtttttaaatggggctattaattttcaaatgaagcacctgaatgaaaacaagacaaaacaaaacactctgagagctaaaccatgcacgttaacaagctgaaatgatcccaagcactgccaggttcaatgctagaacaagaccccgggatgtcagagccaccctggactggtgtttaatggtgttttctttttttgttttcttttttagatggagtctcactctcttgcccagggtggagtgcagtggtgcaatcttggttcattgcaacctccgcctcccaggttcaagtgattctcctgtctcagcctcctgagtagctggaattacaggcatgtgccaccacacctggctaatttttgtatttttagtagagacagggttttaccatgttggtcaggctggtctcaaactcctgacctcatgatctgcccgcctcggcctcccaaagtgctgggattacaggcatgagccactgcgcctggcctttaatggtattttctattggaatgaggaatcccatcacgtgatgtcacctacagggggcgctcaatactgtatcccttccagttgatggaccatcatggagacttgggctcagctcaatgctgaactgcagagatgctatttttttgacattgttcattttaagcgagagaggtgtgagggatctgggttggggttctgggtgcctcccacccctgctgatgtgttggacaccagtgagggagtgaggaggacatggggctgggatcaggacccctgggttcaagtccatgctggtatgacactcttttccactacaggtcaattccctgagaggaaggacttggtcttgtttgcggctagaacagcaactggcacacgcccatgcttgttaagtatttgaatgagtggctgactgaatgaacgatctggggacgttgcttacattatgggcctcagtcttcccatcaataaaatgagaattaaccgtgggtgccctactgaaagggttgctgcaatgagatattggacttgtggaagtccttgggggaagtaatcaaaagggctgtcacaccatgagaaacatctatggttatcttgtccttggctgacagaagggactacttcagatcccacgcagacacagcgaaggacagctggtgccaagcctttctcccaccctcaacctttctgtggctgcatgaaaccagcctagaaaattccccaaatgatcactcagattttcatttccattttgtacaggggtaggggttgaggtgctaccttgcattgtcccggccgtgtgacttcaagaaattcatatctcggtatcgggagagaaacgccaccaactggtcatttgtcctgtggaaacaaaccaaggggagagtcaggccagacaccgtgggtactgtctttgtcacagaaagcaagtttcaccaattatgtcagtctgcttgaagcaccttctctgatcatttgcacacaggctgataaggcatcctctttatatcgccatttttatgtcaccatcactgactctatcacactatgttaaaatgggctgtttgtgcatttctctcctctatactccaatatactggagactctgtgagggcaagtgtggtgctccacatgtttgggaatctccagtgcctggcactgggcttggcaaacagcaagtcagcccaaagctaaatgcacagcaacctcaggacctttgcatttgcttgcctgggaaatttctcccagtattgctggcttggctttgtcatcaggtgtcctttcaaataccacctctttagagagaccttttctgaccacttaacctaaagtagtacctgcctcccgctctctccccacctttattacatcactctgtttataatacttcactcttgtatcaccagctgaaagcactgaccttgcttacattagaatgtaagttccacgaggacagagcccagctggatttgttcaacactggcatacagtaggagctatattaatatttgttgaataaacaaatgaatcaaagtgatgtgtgttcaaactgactccttcaaatgcactttgagcaatgaatgcatcaatgaatggacggataccaagtcctcgataaccacggggctactgattgagagagctttaaaaaatatgaagtccaatacaaacgagtgacatcgttgccagcattgttatcccaaatttatccccatcaatctcagcactagcagtgtaatcacagctaatccgcttgcgcatacagctgtgacagtattttaaaaggcagtcacacgggtctccatctgccagaaacgcagtcgcctcttctgctgaataaacccaaacaggtaaatggtgctgatgtgacagctcctttatcaccagccttctctgcttcggaatttttacttcaaaggaaagcgttaactattgtttcaaatgggaggaacagagaagagagcagaaagataaaaaaacatctctggggttataatagaagctagaccttcgagaagcaggacagtgctttagaaagcaatgcttgggcagaaacagaaagatctggggacagatcccagctccatgactgagtcagctgtgtgtccaaggatgtcatttaacctcactgaatggcagctttctctgaatgcgcctaggttgaaaattaaacatgcccagcacctagtaggcccatcatgcatatatactgaatggacaactgggtggatttaaagggcacacagtaggggcacaatcaatgcacgtcgtcctgctctgcctcccaactctttggtctgagctgcccctactgctcaccccctccttcatttccctgcgcctctgcagtctcgccactccaagcccctgttctctcattggatgactcatgttgaccaactcataattccagcggagggggcacaaagcagttaagagaggcagcagtgaaaatgagcgctgctcgtgtcccatcctattactgaaataaacaccaattcaaaaccagccattctagcagcggcaggcaccagaaacaccccgtgtgtctgcagggagttgaatacagcacacacacggaaagctaaaccttgctgatgggcacagaggtgaacccaggggatgctcgcaaagggctaaccccacgtgtccctacaatggtgcatctcccgcgtggttaaaccccatcgtgcatgccaaggtaaagtccactggtgcctccgacactgttacctgtagtttgtggggacagagcctctttaataagtcgctgggagaggtggaaactaaatcggcctataaaaaaatttaagcaatgtttctctccaaaccataaagaggcccattccaactgcgttttaacagctcttatttaccaaccccctcaccactctccgcaacagttcattattgttgtcctgatgaatacgagacaagttaacctctgaatgggtccccggcagttggaataataaataaggtctctcagacacccttagtgggaggattgaaggggccgggccggggctcctgggcccccttctcgtgaagcctcaggtctcccagggtcagcggctgcagttccatttggcaatcccagaaagcgcctttcagggctgtgagctggggccattttcacatttaccgcttcaccgagtccccatctgacggggatgaataggcatttagcgaatttacttagcgatgcttccacatgaaatcgtctcaaaagatgacatcttgggggagggagggtggatgaggagggggctgaggtttccaggcccagagcttttgggcaaagccgcctttcaaagccaagcgctgtgtgcttggcaaaggatcctgatggattgtctggaagggtggggcggggggacccctgcctaccccccttgctagggtctcgggcccctcgctctccctctgtgtgaaatgcttgctctgaatgctaaagcccatccccccagtccttctccaaagggagatggaatttggctgaggaccaaattctcctattgttgctttcagacgcctgtcgataattgcctacataatatttagttctctccagataattaacagcttgcgatctggtgacattttaccccgttccagtttctcgcgcgctctctctctctctctctctcttccactcacacacgtttctcactctctttttctggtgaagtcatttgccaaatggttcccatagttcatctcttgtatctatctcatcatcaatttcctcctactttttgctgaaatgattagaaatcatgtctcttggtctatgccagttcctctgcttcctgaggataactggggcctgttgctaccaccatgggagtcactgggaagtctctgctgaaataagtaagaaataaatgttaaaataaacttactgggagccatatgagaatctttttcgaaatgaataaaaaaatgagtaatacaataatctcccaagtcccagccatttactaaatgtgcaccatgccctaggccatggggaaagacttttgccacattttattgcatttgatagtcacaatgatgctaaaaaatgtaaattttggctgggtgtggtagctcatgcctgtaattccagcacttggggaggccgaggcaggtgggtcacttgaggtcaggagtttgagaccagcccggccaacatgatgaaaccctgtctctactaaaaatacaaacaaattagccaggtgtgggcatgtacacctgtagtcccagctactcaggaggctgaggctggagaattgcttgaacttgggaagtggaggttgcagtgaacacagatcgctccactccactccagcctgggtgaaagagtgagactctgtctcaaaaaaaaaaaaaaggaatttcacttcactctcattttacggacgggcaaccgagacttagataaatcatccatttagtaaagtgcagaaccagaactggaacctggggacaaatgtcacagcttgtgttctctactacgagactgcctctacaaatgatagtgaatgaacgagtgaatgaatgaatgaatgtattccatttcaagtgcagaagaaaaaaaatacaggcgcaataatgtcttcctcttcatagcctggtctgcagcccactgctattagaaatgccatacttcaggccccacccaatacctattgagcaacagagctcacccaatatctattgagcaaaaatgtgttttcaaacaagattccagatgatgcatgtgctctttaaaatttcagaagcattgctgtaagtcatgtatgactatgagtagttaattctctgctttccatctttatctgctcctcatggtttcttctggagaacccggactatgaatgaattactttcatttcaataagccttaggtcttgagagtattaaataaaaacaatgcacctaatatctgtgccacagtacttggcatatagtaatcccctgataaatgtcagctattatataatagcattattattaccatcttgaacatcagaagcttaagacaccttgaactgtggaaaacagtgtaaagacccaacctgatttgaacttggaaggctttctgtgcataagacccatggaatgttctgcagagcatagtttaagagatgtccaaggccccttcctggggatttgtccaaggtcccttcccagctggtgtcagacttagggactggctcccagagggccatggcaccattgtgtgtgtgtcttatctatataacagctctggacatgaagatatgaaggaagagagggcagagttctcaggttcccatagcacccaggagcccaggctgtatggaaaaggtgccctgggcacacagaggcacacaatgcctgtttgctggtggcatgtgacaagagatgaagcctgctcagcttccactaggaaggagcccaacacaaagccaactgcacctctctgggctcccggtgcccacctggcactcatgccccagaaccccttcccgactgcaggatactgtcaaggaccctgccagaggtgctcacagcccaacggtgaggtgacaggactaaagccaaagttatacgcaggattttgtgaatgtcaggattcaggatttcaaacctctgatgctgccaggtgtgcacagagcccaggggacactggagtaagtcctcctggactgcaatgaacgacccattgtggggcagaaacacacatgaaagactatggggaggccaggcatgcctgtaatcccagcactgtgggaggccaaggcgggtggatcatttgaggtcaggagttagagaccagcctgaccaacatggtgaaaccccgtctctactaaaaatacaaaaattagccaggtgtggtggcatgcgcctgtgatcccaggctgaggcaggagaatcgcttgaacccaggaggtggaggttgcagtgaggagagatcgcgccactgtactcccacctggaaaacaagagcgaaactctgtctcaaaaaaaaaaaaaaaaaaaaaaaaaaaaaaagaaagactatgctggtgcatgagggactgtgaagtcaggcaagttgaggaagttgagggttgaggtgctttcaacctaagctgagaatagactacaacagtgtttccccaacttctgcttctagtgtacccataatctttaagttatttcatatgtctatttaatttaaattctactttagctttatcttatgcaccaatgtttgtgatatttgatgtcacaaatttttttttttttttggagacagagtcttgccatcttaaccatttttctgagatcagacgaggttgggtgtgttcagggtgatatgtctgtagaccatcttaaccatttttcagtgtacagttcagtggtactggatggattcacattgttgtgcaaccatcaccaatatccatctccagaactcttttcatcttgcaaaactgacactctctacctgttaaataataattctctatttctctcttctatagcccctggcaacccccattctacttcctctctgctattttaactattctaggtacctgacataagtggaattgtacaggatttgtgttttgctggctgacttatttaactagcaccatgtcctccaggctcatccatattgtatcataccttagaatttctttcctttttaaggctgaataatactctctcatgtaccacctgtatgttatttttttccctgttacacattaaaaacattaacgaccacgtgtctgtatacttcttaaatcaactgggctaccagaggcacatatggaagaggtcaactgtcctggtttgcccaggactgagggagttcccacaacacaggacttttagttttaaaactggatggtcctgagcaaatgaagatgagctggtgaccccaggcacatggctccattgagggctgtgtaaccacaggagaagtgcacactccacagaggcaaaaatctcaccctcctgtgatcaacccaatgtatagaaaacaagataatggcagggcctattgtaaccttttcctatgcctttaaaatcattatgaaagcttagatcacagcaagataaagactgaaataccagcaatagcaacatcatcatcatctaacacttgaatgcctcctatgtggtatttgcatctattaacccacttaatcctcatgacaaccctaagaggtagatgctattatatttatatccatttgttattatataaacgggaacatgtatatacatggatttttgtgtaatgacctatgctgcttctctcactcatcagcacgtacaggcagacttcatccttttaacggttgcacaggatcctatagaatgggcgtagccagctgggcatggtggctcatgcctgtaatctcagcactttgggaggccaaggcaggcggatcatgaggtcaagagattgagaccatcctggccaacatggtgaaacctggtctctactaaaaatacaaaaaaaaaaaaattagccaggcatggtagtgggcgcctgtaatcccagctactcggaggctgaggcatgagaattgcttgaacctgggaggcggaggttgaagtgagccgagactgtgccattgcactccagcctgggtgacaagagtgaaactctgcctcaaaaaacaaacaaacaaaaagaatgggcatagccaatgccctagtgatggacacttaggtcatttccattttctcccccttacaactactgctccattgaacacccttgaataactatcttttcacatgtgggcatgataggtttctgtaggatcaaatttgcagatatggaattgttcactctaggattatttttcagtctttaatttcagaaagcaaactacacggaatgagacttctctaagaattgcccaagactcacatcattgcacagaaaccaagcctgtggctgccaggagcatggggaggaagaaggaaattgcaaaggtgatggagttgggatgtcttgcagagctggcaggctcttggctcctccagcaggctggtggggttaagcaggggccttctgggttccccaaaggaccaaccaccagcggaccctggaaaacaaaggaggctcacatggagatggaaaggaccttctgtcaagcaacggggtcagggcagaaccatcctctcccatgcctggagcagctgctgcagctggtgatcatctgtctgccaacagaaccagcatctggactatggggcagcacctcggacagtgcttttcaggaccatggctgtagtcctgggatgagcaggcattgagtccaattcccatctgttcctccaggacctgacacatagaaggtgctaagtaagtattcactgcttaatgcaagcccaagtagaggcccggtatgcagggttcatctctgtggcttctatgctcagcacagacagtacctgccccatgggaagggctcagtccatcattcacttttttttttttttgaggtagagtctcgctctgtcacccatgctggagtgcagtggcacgatctccgcttacagtaacctccacctcctgggttcgagagattctcctgcttcagcctcttgagtagctggaattataggcgtgcaccacaatgtccagctatttttttttttttttggtatttttagtagagatggggtttcgtcatgttggccaggctggtcctgacctcaggtgatctgcctgcctcagcctccaaagtgctgggaccacagacatgaggccctgtgcctggcccatcatccacttctgtatccacatctctgcccattccataccctctgccaggaatgctcctccctacgtctttgcccaatgaactggggggtgatttgggggaaggaatcccagagtcagggtactcatgagaaaatgcttcataataacaattgcagaaagatttccctttgttgctcaccaagtgttaagtgctcgtcctccttaattttacaatacacatccaggaggtactcatttgcggatgaataaactaggactggaagagccttcacagcttgtgccaggtcttatgagtggtggaggggagatgcagacctcagtgccccagggccagagcctgagctgttttcaatcccgctttccccgtggtgaataagcttcaggaatgtgatccatttctgtagacagaggcaggaaataaacaggaaactgcagctgccttctgaagcctactacttcccttcaaggggactgttgttgagtgcgagtcgcacaacaggaattgatacaggtagaacctctgttcagggtgtatgtctttttcctgtgctcctgtaaaatctgaagtccagtaagtttcctcctccccctgcctcatgaatggattctaacccatccttccatctcgtgaatggattctaacccatccttccatctcgtgaatgggttctaacccatccttccatctcgtgaatgggttctaacccatccttccatctcgtgaacggattctaacccatccttccatctcgtgaagggattctaacccatccttccatctcgtgaacggattctaacccatccttccatctcgtgaatggattctaacccatccttccatctcgtgaatggattctaacccatccttccatctcgtgaacggattctaacccatctttccatctcgtgaatggattctaacccatccttccatctcatgcatggattctaactcatccttccatctcgtgaatggattctaattcatccttccatctcatgcatggattctaactcatccttccatctcgtgcatggattctaacccatccttccatctcgtgaatggattctaaaccatctttccccacggcttatctgggggaggaggagacactgccagtgctctctcctccacactccagacggtttatgcaaggaccttactgacatcttctcacccactggaaaaatcagggaagtccagggttgcagaccaacagtgaataaaggccaagttcgggacttgctgaagaagagacaagagcaaaagaactggaaaaaaggcaaatccctgattcaaatgcagtcaaagcacatgcacttgtatgttcactgaagcactattaacaatagtaaagacatgggatcgatataggtgcccgttaatggtgaactggataaggaagatgcggtacatacacaccatggaacactgtgcagccatcaaaagaacaaaatcatgtcctttgctgcaatatggatgcagatggaggccactgtcctaagtgaattaacagaggaacagaaagctaaataccacatgttctcacttataagtgggagctaaaaattgggttctcacggacatgaaaatgggaacaaacactggggactactagagagggaagaggaggagggcaaaggctgaaaaataacctagtgggtacaatgctcacttacctaggtaatgggggccttcatacccaaaacctcagcatcacacaatatacccctggagcaaacctgcacacgtacccactgaatctaaaataaaaggtgacttttttttttaaagtttaaaaagtagtccaaatttacagagacttattttgctaagatacggaggaaaaggtatgaaaaatgctaaagagtatgttttcctggactccacaggcataattccagccaccatgagcaactgaggaaaagtgaactggataaaatgctggcccggcctccaggctcctctttacctcgtcctccaggaagcagctgcaggatcttcctaaaacatgagtctgaccatgtcaccctttgactcagtaccttcagcggctctccatcatctgaaggacaatgtccttaccccttggcaaggcatgcaaggttgtttgtgacccggcactgcctactcaatctttggaattacttgaagttttctaaatgttctgtgttctttcataactctaagactgtgcaagcactgtttggtctcctgggaaaaatatgacttccacttcttcaataggtcaggccctgtgacaaacgcctgggacaggagtgggtaagatggttgtggcacctgtcctcaaggaacgcacagaacactgggggatgcagacatataggtaggtccctgtgatatgaagtgagacagcagatgaattgaagcacgagcattcaggggaggctacaaaaagtatgctggggacaccagggggacagtacctccttctacaaaggcaggcagtaaactggagaactacctggttgttacaacccaatcagttttaattggatttacctttttgtactgacaaaaatgatgtggcattaaaacacactcattgtatttgaatggaccggcaaaccatttcacaaagcctcagtgctttcacaggacatttgtaagaaacacatttttcattttaaacatacatatgcctttctaagaggcagtttatctgatgttctatcaatgagaactcttaacacaccagcccttccttcagacggctgtaatggaaaggtaactgacaacaatcagcacccaggggccacgcaggaacccaggacgccaccggaatcatgaatgaactaaactgacattctgcttggtgggttggggggcgggcggggagggtggggatcgtgtgtgtgcacatatgtatatgaagtctatttaactgtattttgattctcttaagtctgcttgtcctcacatgccatgaggcatctcaaatgtgcacaacatttagttaaccaaattctgcattcccatacaatgattgattacagccagttatttgatttggtcttcagggaaccaggggaggtccacttcagagggcatcgaaagattgaatcttaaaagtaaatgcaatttaagtaggaaagccaagacacggctacaaggaaagctgttttcagagaggtgtttacagtagtttctctctgctccttgccactttcttgccgtttgatttttagcaagttcctcaggctcactgagccttggttttctaatctgccaaatgggagcatttaacaatggtctatgagttacttgtgtgttgtgggtatggtacatgcagtgcctggtgcatagcaggtgcgcagtaactggagttccttggaaagaagtttctatattcttcgctagaaatgcagagagaaaggcatgtccaccccttgctagtttcctaccaagctgtgacatttcaattcttacacacttgtggttcctagcaaaaatttaagttatgtatgttcaagttgcttgactgtaagctacctgaggacaagaactttatctgggtcatctatgttccccaactgtccagcacagaggccaggaacatgacaggttccatcagccttatgcctatttctctttgggtccccaggcccatttcactgtagcccacggaaactgctcagcacaactgtgttgcaggacagaatgagggcttttgtccataccatccctaatgccagaaacatccttcctacacctttgcctagagaactcctgcttgcctttgcaaaagctggctcaatgtcagttccactgggaaaggctggagtataaataaccattgaatggcactgaactgtactgacacgctgacctttctctttgtgcttatggctgagaacagatgcctttttcaccattcatcctgccctgggtttattcaaataatcaccatgacctataatactaatttgtccatttccatttcaccacataggtcttcctaacgcacctacactaatgtatcagaatttgcagtggttaaaataatgcagatctgacatcagagaaatgtaggtttgagtcctagttctactacttattggctgtgtggccttgggcaggtcatttttagctagtcgatgctcaattttgtcatttttaaaattgaggataataacactatttaccttatagagttgaagatgtaatgaaataagagggaataatctgttgcttgcaactacaaaattctagctgatacagaaactggtatcagaagtcgggtaatgagtgttgagccagtgaaaacaagagagatctagtacagcttaggtaacctagcccacagaatgctagaatgtcagatcttattattgttattatttttattatcatgaattctccaggactagagtctgcactgtgccaggagtaggatacagcaaggatctctaactcccagaactttgggactgggtcagtttggatttcagccccaaggtgagattgagcttgaaggacagttgatagtgtcaccaagcatctcattctccttgggcagcttgccacattcacctgcctgtctgtattggaacaaggtcaaaatgcactgcaacacaggcaagaagtcatacacaccatggaaaaacaaacactgtggtttctgcaacacagagatcgattctggaggatcaggacatgctgcgtccagtagactctttacccacagatttccaaggttacttgtttatctcagagggctgatgagaaatttcaaaaggatttttaaacggattttttctttttaaacagaggacacaggccttgaagtaacttgacagttcctaggcaaagaaaacttcagaaatgatttaaatgagacgttatcacatagatcatcggtttttaagctgcatctgggggaaccccaggttggggctgggcagctggggcctcaagacacctcagtagaggtttccttactgaggactcacttccacccctatattgggtaaaatttcaattgtgcaaaaatggtttagtagcctaaaaacaagtgttcaaaaatcatttaaaaaacggccaatttaacttccagttctcctttaggagaggaaggaggctggcatcttactcaatagcagaactggctgagctctgccctcactaactgcccaatcttgggcagatgacaatttttctgaacagcactgttgcctttataataacaggaatcgcaatatgacatgccttgtggagttgttttggggttagaaggaatgatatcaggttaacctgttagcatgggtactcggtgtacagtaaatacttagtaagtattaactatgttactcttgcagctgtgaattaaatttctttttattccctccttccttccctcctctctcccttttttttctctccctcttccatttctctttccttttcctttgtccttttctttcctttctcttcctgcatcctgcctactcaatctttggaattacttgaagttttctgaatgttttgtgctctttcataactctaagatcctgcaagctctattagctttcctggtaaatacaatttcccagttcttcagcaattcaggccctgccataagcatttgctgagcatcttcctatgtgccaaagactgcgttcatttcttttttttttttttttttttttgagacggagtctcgctcttgttgcccaggctggagtgcagtggcgtgatctcggctcactgcaacctctgcttcccaggttcaagcgattatcctgcctcagcctcctgagtagctgggattacaagcatccaccaccacatctggctaatttttgtactttttaatagagatggggttttgccatgttggccaggctggtctcaaactcctgacctcaggtgatccgcctgcctcagcctcccaaagtgctgggataacaggcgtgagccaccgcacctggccgactgtgttcatttctgacttgagacatgaattctgctttttcaacagctgggtatcactttgagttgtatgggcccatttcattgaggacatttaagcccgggttttatttgactctacatgagctcatacctcctgcttcttgggtaaaagctgttcatttacagatatttctttcttttcccagagaggtatttactcaggggcaataccttagtcctgctccttctgcgctcctatggtgactgatacagtgctttactaacaaacaaacaaacaaacaaaaaaaaccaaattagtaacaaatgtcatctgggatctgatcacataaactctgccgggaagatgctgacacaagttcattgctcgctgatgaattattttcagtgccaggtctctgagtatttaaatggctgcattgtaaaaacaggatcgtattataaattgtcaaacaggacgtgtagtagatgaaggcagatttgtgcacgccacactacctccacgtactcattcagcaaacatttatgttacagctactatgagtcacgtgctgtttcagatgctggagaaacagtgaagatgaagacaaaatccctctgagaatggagctttggtgttccgaggcatccacgtacatcctggattagcttccctctatgcattaagagcatactagtcacataccatccttgctagaatcaagaacacaggcactctgcccacttcctgtgttttgtggctcaaatgaggaacctcagttgagcaaggcttggctagcgccatgtctggcatattatagttgctcaatgcacacagggacaaaggttgaatgcaatctccgagtctgtgccaggttcctggaatggaattcacaaactcggacagaattcctttcatgctaaggcagatacatcagcaggtccagctgagacgagcctaactgagtgacagcttgacgtgctgctgttctgcagaatcatcattcggcaaaaggtgaaataggtttaaagatcatctctactccttaatccttgcggtaccaccttgcaggtttctttatccttctgagcctcaatttccttgtctaagttgagcaaagatttgatgagatcatgggtgtggaagactcaatccagtgcctgccacatagtaatcgcttgattatctggtagcccttgttttttatttggctctgagtgagggagaagggtggcaggcttccccaggctgcaatgtgcagtcatcaaaggttttctcagggaagctgtggtccttgggatgttgacgaacccaagagttagagaccaaaccaagaccaacctctctgtggttgttccctggctggccctccagagggtggccaaaaaaataaataaataaaacacaaaagaaagatatacatctacagaagctgaaattcctctgtttttctactttatcttattacttcttccctttttctctaaagtagctgaaccacatatgttaagagtcattgtaatactgaaaagaatggaaaacaggtgttcgaacaaaacttggccatgctattcatggcagcactactcacaatagcccaaagtagtaacagcccaaatgtccatcacctgctgaatggataaagccaaatgaggtctatccagacaatgggatattagtcagccatagaaagagatgaagtactgatacaagctacaatgcagatgaaccttgaaaacataatgctaagtgaaagaagccagacgtgaaatacccacatgatgtatgattccatttatatgaaatattcagagttggcaaatccacagaaacagaaagcagaccgggggttgccaggggttgggggtcagaggggaatgaggagtgactgcttaatgggtacaggttttccttctggggtaactaaaatgcttgtaactagatagtgattatgctcatataccattgtgaatgtattaagcgccactaatttcagttgtatattatttttggcatattaaatataacttgttttttgagatgaagcctcactctgttgcccagggtagagtgcactggtgcgatctccgctcactgcaacctccacctcctgggttgaagcgattctcttgcctcagcctctcaagtagctgggattacagacatgcaccaccacatctggctaattttttgtatttttagtagagacaggctttcatcatgttggccaggctggtctcgaattcctgacctcaagttaccgccctctttggcctcccaaattgctgggattacaggtgtgtgccaccacatccagccaacatattttaatgttattatttatgtttttatttttatgccacaataaaaatatgacagttgaaccccaaaatttcaaactgagaaataaaacaacagctacaataataaccatgtttggtgtatcctacctattttatatacgctatccacctaatcctcacaacccccctaaaataggcagcagtagctccattttacaatggagcaaacttctcaaaacttgggcaacgtgtctaataatcatgatgatcataacaataataagtatagaatataagagttgcttgctgaggcacttgttacatatcggctcagtttgccttcccaacatcatcatgatgtacatattatcattatcacccattttacagaggaagatgaacagagaggttaagtgacttggcctaggttagacagcccacaggtaacagaaacagggatttgcacccaggtcatttgacctcagagtccatatgcatcaccactggagcccgcaggcgtggtcatggagccgggaaggaatgtggacacctgcagaacttacctccctgtcctctctcatggaaaatgggaacagactaggtatctgctccatgacatcaagtgacttcatgggatccagaccttcccccaggctgcatggaagccagcatatagccagacaggtgtgatatgtgaatgtccctctggcctgccaggctcccagacacagatccttgatatctgtgcaggcacctccactttatgtggagaagcagctgagccaaccttaggattcatgagtacctaccacagctcactgtccttttgaaataaactctccagctctttggaatgttttctgttttcatggtggtgaaatctgaaaacgtctctaggtgaaaagacattaagtaaagacaaaacccctccactggtcctcaatctaggaataagcccagagatgtttttaataaatggggaatgcaaaaaaaaaatgcggtaaaatatcagtgactctcctggcacttagaaataaaggaccacagccactgcagccacagtggtgttatatgggacaaacactgagcactcatttgctccttcatgccttacttcagtaagtacttactgagctctcactatgtgccaggcactgtaccaggaataagacacagtggtgagcaaaacagatgtcatctctccacttgtggaactgtcacccgggcagcttgggtcaccatcactatcatcgtttctcgagccctttctctgggtcaggcaaggtgctacacatttcacagcttcatccttacagtaaaggctgaggcaggtaactgatggttcccattttacagatgagaaaactgaggcagagacaggttgagcaacatgcccaagggcacgtggccagtaaacagaacagctggaaattgaactcaggctctgctgcctcctcaagtgcacactttcaaccgctttgctgcactggcctgagggcctgagccctggaaaattcctgccgactagcagaaggaggtttgtaggtccagttccagatccagcttacagggtctctccaggaaacccagggccacgaagcctaagaataaggtatgctgcagaaaagctcaacaccaagagaaaataatagcaacaaagcaacaggaggcatttagcctggtggaaagtaattacctgagctataatgtacatatctactagcaaaaaatactagctatcatgtttcccctcctccagcaggctggtacagtcctctactttttttttttttttaactttctttttcccactgccaagcaactgattataaactgaaccaatctcatcatggcattttctaatagaaaacttttcaaaggcttcccattgcttataggataagcttggactccttaacctggctctaaaggtcccacacggtctggcccccacctgcctctctggcctcattctattggcttatccccttgccacactctgtccacataagcctcttttcatttaccacagaagccatgttttctcctgcctcagtgcctttgtgcatgcagcccctgctgcttgcaatgttcaccgccccctttttttcacccagttaattcctcctcttctttcaactctcaggaaaccactgggcagagggcactccagcctgctgcccatctccttcttagttttacataaaaggagggggaactgatggtaggattacttagtgccagtgagattgcttgagacgtggttatgggatgggtacttctccagggaagctttccctggtcctttagaagagaaggggtgatatgcatgtctgtttcctgcattatatgcatgcaaatttctttcctgacaatgtcatgaagatgtcattatttgatggcttaatctgtatattcctcaaaggcagcgatgttaatggttctattggtgtctgtaaccccaggtcctggcaaatgtctggcacacagtaggtttccaacaagcatctgttgactgactagaatgtatgaatgaatgaacaaattcacagtgacgccctacagctgatagttcattaaaatgtattttgcggacaccaccttggttaaaaatctctctcttcctgaattaacattgcaacctgagacagacttccaagataaattacaggaggggagcccagacacatccaggcagtgagtcagtagaaaaccagacacacaagatcaactggatttatagaaagtactagaggaacacatgtccagtcactctgggaaatctttgagaattagctggcattaaggcattagtcagcaacttgcctggtcaaccaaggaaagataaacgagctctgtgcttttagcgggggagcagaaacttggggtaagtgctgaaatcaacgagtctcaggattcaatgacattaacctttttgattcagattgaggaaggtggtgcagggtgaattacggtgctaatgaggaccaggtatttatcctgcgtttaggcagagaaggctgggtggtaagaaaaccggtatgctctggctggcaggaactctgcggggctggatagccatggaggactgtctgtgtgcaaactgcctgtctcctctcggccgcccctggtcaggcaacactgatgggtgagctgtgtttcatgtgctccttaccagctcaaggtcagaaatggcacacgaagtaggttaggggaacataaaataaagggagcctgctgtttaataaggggttcagctacccaggactgggtagaaatccaggtcaaggcctaggggaggtagagcagaaggccttggggatctccatcactcattctctatccagggtcctgaagtctgaagcacttgaggtgattcagattcaaccccacctgggttgacagaatcatctaagatagtgaagcaaaggccatgcctaggaagatgggtgagtgggttggcactaaatttgaaagggctgagatgtacgtgttctgggcaaggccacgatctgaaacatgggagatctggcagaatgatcaagtgcaaactattgcctgccacctgtttttagaaagaaaattttactggaacacagtcatacccattcatttacatactgtctatggccgccttagtattacaacagcagagtttcgtcatcctgagagacatatatgtaccacaaaacctaaaatatttactatctggccttttaataaaaacttttgaggctgggcgtggtggctcatgcctgtaatcccagaactttgtgagctcgaggcaggcagatggcttgagcccaggagtttgagactagcctgggcaacatggcaaaaccctgtctctacaaaaatacaaaaattatccaagtgtggtgacatgagcctgtaatcccagctactcaggaggctgagatgggaggaccacttgagcctgggaggtcagggcttcagtgagctgtgactgtgccactgcactccagccagggtgacagaatgagaccctgtctcaaaaaaaaaaaaaaagtttgttgaatgaacggagctggaggcttttatcctaagtgaactaacaaaggaagagaaaaccaaatacatattctcgcttgtaagggggagctaaacattgagtacacacggaaacaaagaagggaagggtagacaccagggtctccttgaggaggcagggagggtgaggatcgaaaaactatcaggtactccatttatcacctgaatgatgcagtaatttgtacaccaaacccccaggacacacaatttacctatgtaacacacctgcacatgtacccctgaacctcaaataaaagctagaaaagaagtttgttgatccctcgcctgataactctcttttttgggtcattcacaatcttcctcataactttctggcatatccgtctaatcgaagtgtcttcctgacccaccctatcctctttccatgcaatagttttcctggtactcatttctacctgatatatgacccgctcacttatctactgtctctttctctaatgagcatggaggatgcacaacagtgcttgctttctttactgccatattcccaacccccagcaaaatggctggagtataccaggcactcaataagtacttgccaaatgactgaagagccacttaccccttgtattgttgccttgttaatattttctcatttaaatcaactttcattttatttatttatttactttttatttttaaggaaacttcagcttccaaaatctgggctgaacatgttcctattcccttctatgtgttaatatagataaacatggacattttcaaagactcgcctgcatttctctttaaatcatcttacatactgcaagcggcccacaggccatacttgggaagtcctgactcattgttaaggacatgggtgggtttaagctccactgagctccacttctgggtagctgagcatctgctcaagtcccttctcttgcaaatggggacaatgaaggtcccatctcaccagatggctgagagattaaaggagaacatagaagaagcacttagcacctgcagaaactcagtggcagggaactctcaggggtggggccatctcccggtcgctcagttcatgacaaagcagtgcccccttggtactgcagccatcactgtcatgaagcctgtctgagacactgccccaattcctgaatggttgcaccacaacccagcaaagcaatttggattaatgggactatttagctgtaggtgtccagagaatgcattgtttaaagtaacttgttggaaacttccccagggtggcaaattttaaacaaagattgactctgtaatcaaaaattgcttctgcttggccttaaaccagattccggcatcctgaagagcatgattagactgagaaagggtggcaatgtttgtgcccctggctcggtttgccaagtaatgttgactgatgaatacaattaaattgcactgaggagaatccctccctggaggagaaaggacataggagacgggtgatggcttttaggggcacagtttttcattccttctccataagggaacaaccaccattgtgggattccccttcaccccctaccatgggaaaactggccagtactaccaaatggccttccccttcccattctccacttttggattaactggtcttataggcagtgggccaagactagattccaggttctagagacactccatctgaccttcatgggcctgcttcacctaagctgagtgggagtgggaggaggcagcaggggagtctcatgaaccatgaagactttgctctctgcgttggcttctgttccatgatgatttcctaggaagctgacctgcccagatgtccaaatcactttctgatattgcctggggccaccaggggagggtcagaggcaggccacttgagcatggggatggggtgagggttggtgaggctgggaattggaaggaagtttcccacttgaaatttcaggtagattgcagttgcattcaaaaagtaactggagaaatgcacttgatttttcaaagtaagtggagaaatggacttgagaaatggaatatgttgtttcacctcattggggtagagaaggccagtaaacactagggctgtcttcaaacagccttgcagcagggagggaatatgggggcccaactacaggcaaagaaggctcagctcaaggcaactaccttcctcactctcatcacgatcagacttcctcaaaggcaggtgccccctgcccaatctgcatttctgtattagtacaaggaatagagacataaaatataagaggaagaaagaaggagagaataaggaaagtgaccacacaaggccagaccatgtttttgtccagaattaataactatacaggattattaattatcattgtcatcactaccattatcatcaaaaaatttccttgttaaaaaatgcccaattccggattaggtcctgtgttccactatctttcatgtttctaacaatcctatgaggaaagtaccctggggagggcactctagcctgctgcccatagcaggttctcctctgcccatctctctcctacatttacccaaagggaggaactgagggtaggattacttagtgctggagagattgcttgagacatggttattagtgggctagatatctgttctgtgaacccttcctcctcccaaatgaattgcacttcttttttttttaatgtttcttgcctcaggcctgggtggtacttaagcctcttggggccacgatgagttaccccaaccgcttgatgcaacggggtgggtacagtaagctaaggtctccctggtggattcaaccatctctccttgctttgtatccatcagtatgaccaagcatcctggtcccaatgttttgatggtgagaaggtggagaggaggtcacatggagctgccagacctgagccaccatgctctgacctagctgtcatcaaacagcttgaaataaagcagtacctggagtcccacctggctattcttccttttaccgctccctgatgggtagcatggtcatgccctctcacaggtgagaaaaaggagactcacaaaggttggatttgttgcttgagagcatatagctctcatacaggggatgaggacaggtaccttggtctgtacaggctgctataacaagacaccataactgggtgggttaaacaatggagatttatttactcacagttctggagactggaaagtccaaagtgcctgtcaattagatgctggtgaggcctctcttcctggcttgcagaaggccaccttcttgctctgtccttacatggcagagaaagagagagcgagctctctggtgtctcttataaagaaggacactccttctataggatcagggctccatgcttatgatctcattttaccttaagtacctccttataggccctatctccaagtacaagggttagagcttcgacatataaattttagtggggcacggttcaatctatagcaacaggattcaaatccaggtcaggctgatattgcatggcctcttctacatcgtagtggaatgacttgatggtgtagaatatgccagcattgctttgagtttgctttgattttgctttgaaacaattaggcatatgtggggggtggggtggggggagggacagaagccattcctttctaattatgcttgcattaggctaatatttaaatgaatgagaattccactgggcaccaccagatagccagttagggtagagatatggagagtctgaggtccaatgggaacaggattacaaaggaatttgaaggttggggttgttcttgctaacgcaggacagatggttcctaggtctatgcttagagcacacagtcagtaaagcttggatattccattagagaaagaaagagaccatctggagatgggtctacactggcttttggctttggcagccacatcgtagtgttggcatccttgggtgatcggctttccctccctggggtcaaccacttacacaacacactgcataaagcatggtgaacttcagggtcagctaagcctgcattcaaatcccagcttggccacgatcaagtcatgtgacgttgggcaagtcacttgaacactctgagtcctggtgctgttctatatgtcatcttactgggatgccatggggactaaagcagaaagtgggggcaacttggcagttggctaaacattaggtcactctggatctcaggttctgatgtaccctgctcatctcttgatacgtggacaactctgcctcctggattctcatccagatacagaaaccaaggatttagatggggaagaaatgagtgagagagctttaccccagaactatccagcaggtgaaattatgacccgttggcaaaaaactcaggtcctttcctctctgcccctactccccgtgatgaaagaagcatgcatttaaatcctggctccaacccccaccagttgtgagacactgagaaaatccctttacttctcacagccttggtttcttcatactgcgatgcagtaacactatctaccttctgggattgttgtgagaattacatgagataatgcatggaaatcacttggcctagaatcctatgcacagtaagtagtcaagaaatgtcagcaaatatgattagctactggagtatggcaggtcttaaaaggctttcccaggcatctactttgagtggctactattgaccatgctggacaatgactcagggtgggagcaagggagagaaaatacttgaatgataataagaataatccacagagtccgtctgtgtgcctaatgatcagaccttaaccctgtcgcttggatcctatactcagtcaaatctttgccctcatcaatttttaaaagggtagaaacgctcctcccttatcccacttttaatacatgcggttcctccagattgcccttgaaaagaatcttcacctgcagttagatgtaaggaacaggcaagggaagaataatagactctacaataaagaccacccacattgtagaccaccccgggctcacatccaaattcccaggatgcacttggagcatcccagcatggataccgtccatactcttggccaccggagaaaaagtcacataaaagacggcttttttttttttttttttttgccaataagcaaaaatgctcaatgcactgggcaggaagatgccagggttggaaacgtcccatccacagacacatagagagccgctgccaagaggaaggagaattgtgagatctggagagggagggattcggaagaaaatacattgcaaaattcattgtgtggtcaagctgggatctggtgagaatatcaaattggcagaggacagagaccacatttatttctgtactatttagcctggactctcttttcttctggtaacagtagtataattctctctagtggaagtgtttgtaccccatggcatcgatgtaaggttcatgagcgcacagttttaatttaactttaaattaaaatcatatcaaattgaaaatttagttcctcagtcccacaaggcacgtttcaagctctcaatggccacctgtggctaacggctaccatacaggatggtgcttatagaacatttccatcacccccgaaagttccactggacagtgctggtctagagcattgcctaatatctagcagaatctcaatgagcatctatttaatgaatggatgaatggccaagtgctctattctctgctagccaaagaagggatacacaactcaagagagaactatcacatttttccccaggactctgaattttttttgttttccgttgtgaaagaaagagaaagcaaacaaaatagcaagcaaacaaacaatacaactaaaagttatttaagccagatgatggcatcccttgggtgaagcagtcacttcaattcttgtcttccaccacatccttcccagaaggtcctaagcccatagaccactcttggctttctgcagaaccttggttttcatgagatctccgagaactctaggctcactctgtttgtccagccgatggtctaggtcacttctggccttaagaaggcttaaagagctgaccagcctaaaatacagctcaggagacccaggacaactggcaagagggaagcaaactgcatttctgcaaaagcaggagtgtgtgctccatcagcctgaaaaataacagggctgaggatatgtttattttgtgactagaggcaaacaaaactgttaacggcataattactggcatgtttttccagtctccttgtgaacaacagtccgagcagatacaccctttcaaactcacacattatctgggtggaggttttattggatggtttcgaacccaggaactttggggtctcaggaagcagagtgtgtgtctctgaacgtcccaaagaacaaaagtggtttggatgctgagaaagcagaatgcaggggagatggtcacacccaaatatctgagtgttgggccaccaagtatgctttcccacgaagtactgaggctaacattttccaacacagcatgtagcttctatttatttttctaactatgtgaaagatgtctctctctctccctggaccagtggatttcaattctcactagtacaatcacctgcagggtgctggacactttaaaaatatatagattcttggctgggtgcagtggctcacacctgtaatcctagcactttgggaggctgaggtgcgcagatcacttgaggtcatgagtttgaggtcagcttagacaacaaggtgaaaccttgtctctactaaaaatacaaaaatcagccagatgtggtggagagtgcctgtaatcccaggtacttgggaggctgaagcaggagaatcacttgaactgggaggtggaagttgtaatgagctgagattgtaccacactccagcctgggtgacagagtgaagactctatctcaaatatctcaaatatatatatacacagagagagagagagaaattgattcttggcatccacaaggaatttacattcagttgatctggaacggaactctagatttcttttttatttttattttttaagacggaatttcactcttgctgcccaggctggagtgcagtggcgcgatctcggctcactgcaacctccacctcctgggttcaagcgattctcctgcctcagcctcccgagtatctgggattacaggcatgtgccaccatacccagctaattttgtatttttagtaaagacggggtttcaccatgttggtcaggctggtctcaaactcctcacctcaggtgatctgcctgccttggcctcccaaagggctgggattacagacgtgagccaccatgcccagccgatttctttattttgagcctcccaagtatctggcgttacaggggtgcaccaccacacctggttaatttttttttttttttttttagaaatgggggtcttgctttgttgcccaagctggtcttgaactcctgggatcaagtgatcctcccacctcggcctctcaaagtgctgggataggcatgagccactgcgcctgctgaactctgaatttctgagaatcacatagaaccttgatttgacccggctgagaagcacatagtgagatgtcaagctccttgtggcagggatggtgtctgtcctgctccctgcggaacacccatagcctgacgcatgacgggtgctcaggaaatggccttgagaagcagctctatcctgttttaagagtctggctcagcctgtcttctcctgggagaccttggagtccccgtcagagcacacctgtgctaatattgcaggtgtaaggtgaagagggtctgacctgggtggggatgaagggcatcacagatggggatgaacacggagagatgtcagggttagaacgagaatacgcaaggtgcagatggagcagcaaggaagggggcacacaggcttccagctgcaggtgctcaggaggagggtggtcctattcagagaaatgggggaaccagaagggtgactgatataggataggaagacattttggattcttctaaaatgtagaagaatcagtccaggtgtggtggctcatgcctgtaatcccaggactttgggaggccgaggtgggcagatcacttgaggccaggagttcgagaccagcctggccaacaaggcaaaaccctgtctctactaaaaagacaaaaaaattagccaggcatggtggcacgtgcctgtaatcccagctactcgggaggctgaagcaggagattcccttgaaccagggaggcggagcttgcaatgagccgagatcacgccattgcactccagcctgggtgacagagcaagactcagtttcaaaaaaaaaaaaaaaaaaaaaaaattagccagatgtggtggtgcataactgtaatcctagctacttgggaggctgagggatgagaatcacttgaacctgggaggcaaaggttagagtgagccaagatcgcaccactgtactctagcctgggtgacagagccaaacgctgtctcaaaaaaaaaaaaaaaaaaaaaagaaagattaaaaaggtcaattttattttaagtgtattttatcacttttcttttctttcttcttattttctttttgggatggagttttggtcttgttgcccaggctggagtacaatggcgtgatctcagtccactgcaacctccgcctcccaggttcaagcaattctcacttattttatcattctcaccatattttatcactttaaaaaaaaagaacaaaagacaaagaggggtctccaccatattctttctcacattcactcaacccacattcttcctctaatcctctggctgcgcccctgttggcttatgattggcttttttctgacccgctctcctaagatccttgcatctcacgcttgcttctctgttctctgctccagctcctgttgaaatcctctgagtctcctgaacgaggctgttttgcacaggtgtggggtcctggtccccaaacagaaggtggctgcctggctctgagtgactaaaagacttcatggctgcttgggttcaggaagctccttatggcttccttctaggacacctgcttctgcctggaggtttggagaatagggggctctgtggatgtggctctggggtcagtagaagcaactgcttgtgatctggcctccccactcccatttgggccccactcccaactattctcccacggcagccagtacgatctctcaatgtggcaaatattgtcactctcccctaaaacctcaccgctcacagactgaggctttagtgacccaacaggacatctcaagtgcccacatgggcttgcctcgacctacctcatttgtaagaaggcaaaccctcgcctcttatgtttcacccatagttgccttctttcagatcctcagatatgccagggtcccaagctaccccctcttcctgggatgcctgcttggaacctcctcacacttctcctaaactcctacccagcatctacatctcagttcacaggctgcctcctcagggaagccatccgggccctcagtccatgtgagattcctttgcaaagtgctcatagatccttcattcctttttttcacaatgcttgcctgactttgtcatatgtgcactcctgtgatctctgtgattaatgtctgtctccttcctctattaataaccatggctatcacatggataaccctcactgtgtgctaagcacttcacatatatggactcacttagccctcaaagcaaccctatggggtggtgccattattatgcccattttacagatgaagtaactgaagcacagggactgctgtgtgcaacttcacacagctagtaaataaagaagctgcgatttggacccaggtggactggctccagcctgtacccttgaccactacgatgagggcagggctggatatgtttttcctcacctttgagttgctgcttagcacagtgtccaacacatagtaggtgctcaataaatatttttttgggtgaatgggtaaagtcagaaggagccctgtctcctgaactcatctgtgggagtagagaagtatcttcactgggctgacctaagcactttcctcctcaaagcaccccaagattgtcatcagaaggggcttggtgttgagagaaggaagaagggaaaaagggaagcttggacctcacactctactcctccacatttccatcttcaacctgaatcttccccggacaatgagaatcactgaagtttctttcccgttcagctgaggtccaggggctagcatgggtagagaagatccggtgtgaatgggaaaggccatcaggccaatatgctcagatctacaaccccccatggccaaacagtcaccagggcttgcttaacaagagtcctccagcaccactgctgggcagagtcccatatgatggagctgcatcttcttaaaccagatgaggtcctcaattcagggcatacagtgcagatacaacatggccaggagacaggggctttgggaagcttcagaatgctgagtatattgactgataattggataaacagattgtggtacaagtatatcaacatgatagaatatcagccataaaaaggaatgaagtgctgccacatgctacgatgcagatgaacctcaacgatattaagctaagtgaaataagcaggtcaccaaatgtcatatactatgtaactgcattcatataaaatgtccagaataggctgggcatagtggcttacacctgtaatctcagcactttgggaggctgaggtgggtagatcacatgaggtcaggagttcgagaccagactgaccaacatggtgaaaccccatctctactaaaaatacaaaattagccaggtgtggtggtgcatgcctgtaattacagctacctgggaggcagagccaggagaatctcttgaacttgggaggcagaggttgcagtgagccaagatcgtgccattgcactccagcctgggcaacaagaggggaggctccatctcaaaataaataaataaaaatgtcaagaataggcaaatcaagtccatagatacagaaaggagattagtggttgccagagactgaggagaggtttctgggaagtgactgcttaatgggtacagggttttcttttgggatgatgaaaatgtttaggattagagagcgtacggttgcctgacactgtgaatgtactgaatgccattcaacaattcaaagtggttaattttatgttatataaatttcacctcagtttctttttattattatactttaagttttcaggtacatgtgcacaacatgcaggtttgttacatatgtatacatgtgccatgttggtgtgctgcatccattaacttgtcaattacattaggtatatctcctaatgctatccctcccccctccccccaccccacaacagtccccggtgtgtgatgttccccaccctgtgtccaagtgttctcattgttcagttcccacctatgagtgagaacatgtggtgttcggttttttgtccttgcgatagtttgccaaggatgatggtttccaccttcatccatgtccctacaaaggacatgaactcatccttttttatggctgcatagtattccatggtgtatatgtgccacattttcttaatccagtctatcattgatggacatttggattggttccaagtctttgctcttgtgaacagtgccacaataaatatacatgtgcatgtgtctttaaagcagcatgatttataatcctttaggtatacacccagtaatgggatggttaattttatgttatataaatttcacctcagtttcaaaaaaaaaggatcatgattctacagtttactggctgtagccttggggtcaagtttcttaacatctctgtgcctcagtttattcatctgaaaaatggggatatcaagagtgcatacttcagagttgttgtcaaaacgatgtaaacaagcttgtccaaccctgccttatttggttgttctgttttgtttttttgttttaggcttttagcagcctgaagccatggtttttagtttctgtctctagtgataagcagaaaagagggatgaggaaggggctttactggcccaaccaagaaaagaaactgaggagccataactgtattctctccctcagacatccctgaattgtaaagcacttagaataatgctaggaatgtacgaagtgctacatatacatttgctgtggttgctgtgcggtcttaactacaggaattctttgacctattcgggttccactttagcagactaaagggatgtgatctgtacgcagatgcagtgactgtacatggatgcttggacttccatactgctcatcttcatttcaaatcccagagtgactgggatctgtgctgaacattatcaagggcttgacttccctgcaaagcttcctctgctctgtgttaatactaatttctctaaacttacttaccaagtagcagttgtgttttgggggatgggattaagaagaaatatgtggtaaagggccctgaagagggcccagcacacagtaggtgtgcagtaagtgtctgctctgttagtctgggggttagtcttgctcaattggtcccatataaactctggtcttcgggagactgtagagaagccctggccacctgttcctgtctttaccagctggtgtttcctactgaggcgccatggagcagctctctcatgttctcagcctgcggctctggtagtatctcaagacagacatttggatctgcagttaatgtaacttacatgtccatgtggtgggccctgatagtttggactttgttgatgtggatacccaagaggcagaagtagcaggaaaatgtcaacatggtttcccctgcctggtttctgtatacatacactgccccacatgtgcaaacgtgtgtacacaccacagactgaatgtgaaccccgggaggggccaaggacacactcaaccctcctctctttacatctgatttgccccaagacaccggacttaggaaaagacacagtgtgaggcgtgaggtctctctctctctcttttttttttttttttttttttttagatggagtttcactcctgctgcccgggctggagtgcaatgtcatgatctcagctctctaccacctctgcctcctgggttcaagtgattctcctgtctcagcctcccaagtagctgggattacaggcgcccgccaccacacccagctactttttgtatttttagtagagatggggttttaccatatcggccaggctggtctcagactcctgacctcaggtgatccacccatcttggcctcccaaagtgctggtggcattacaggcatgagccaccacacccagccgaggtctcttactacaagtccaagccaagaaacagggcaaagtgctattggcttcatctcttcctgcagccaatctaaagtaggccaggtataattccttgcctcggtaaatagaacatacgaataaaaccatcatacctttcgaggattcaagatctagcagggcctcagagtttgaaagtatccattttccactttcatccacgtgctgggtacacaaccagctccagctggagcctacgtggaccaggatgtcatgtcaacagcagagcaggagcacctagagtctctaaacactctcagcttgcgtatgccaagttcaggaatattcttcatgtccacaagtgaattggatctattctgtttttcttgaaacagtctcacgtctatctttgcttttcccaccctttttttttttttttttttttttagacagcgtctcagtctgtcacccaggctggagcgcggtggtacgatctcggctcattgcagcctctgcctcccgagttcaagtgagtctcatgcctcagcctcatgagtagctggggttacaggtatgcacaaccatgcctggctaatttttgtatttttagttgagtcggggtttcatcatgttggccaggctggtctcgaacccctaacctcaagtgatccacctgccttggcctcccaaagtcctgggattacagttgtgtgccaccgtgcttggcccacttttccctcttttgacagagatgtgagttcaagaaatactttgctactcttttaactctatcaaagagaaaagggaaagtaactcaagtcccacagttacttatagccatggagtaatttgggcatttatcaaccactttctgtcattagacgctgtggtaggtccttatcatgcaagatttcattgaaacttcctaagaaccctccgaaataggcactaatattgtgtttattttaaggtagagaatttgagatgcagaaagttgaagcaacttgcccagttggtggtggggcagaatctgaaaccaggatgtctgcgtccagggcctaaacaaggctagtgaccagtaaacaccagtgcatctttaatatctaagagaggaagaatctgcccacacccccccaccccccacagtgagggttgtgcaggggacacagggaggtgacgtcaaatcacagagcagctcacagtggctacgtcgggctggctggacccttaagtatcccccaagttttcagtgcctcttagaagtgcctgacttgggcactaccgcccctttgagaagactcctaagtttgctcattctttctgggatgggagaagtagtggttttggaagctacagatggggcggcagatggaaactgaaaacctatcagcattgcccaggatgaaaccattcatctgcaaaattcatatgtttttgtgtagggcaacttcatgaaaacaacagcaagaggaaccagcagtgcttgatgcataaagtgcctctggctatgaggctggcaaagaagagtgggcaaaggaattcgtgggaggcaccatggaaatgagatcagtgaagtagaggaagatgatgagaaaggccaagagacacagagtgacctggggcactaaagcaaaaaagccacaaataagacaactctcttttctgaaccccaaaataggttgcacgcatggcctgagaaaggatttctgggcctctcagagatacaagatgagaccttggatgtaccttacgtataaatggctgacattcatggagcaccttccaagtgtccggcaggctgctaggttctattattgtatcctgatttcacagaaattggatttacttgcccgcggtcacgctgctagctaagtggcagaactcagattcgagccgtaagcagtttgacgagagtgcaggcactcaccctcccgggtgctgagccgagctggactctttaggggaggtggccacgcaaagcaagccaacaatggcctctagggggcagcaatgcgcatgcctacctggcctcaagtggtcttgggcttaatgcgggcccccaacctaggctggcatgacctctgaggcctccactgggaatccagagaaggaagaatgtgggaactttgagcacagcccctaagactgaggaacagacaatgggggtcctcccaggaccatcctggacatccctgctgcaggcagtccagccactactccaccccgccacaagctcatggggtgggactgtttccttctgtgctttcaaggtggcctggggccatcctgccagtccagttctgctgatttccctaagaggccgactaaaagccagaaggaataccaactttgcaaccagacgaaactggttctaatccccactctgccatgcattcatcacatgacattgggcctcagtttgcccctctgtaaaacaggtttgttgtaagggttgaaacaagtgtctgccacactagctgctatgctcagcattttgggacatttccaaactcggtcccttcatggaagatggagagggaatgttctaacccctccttgccatgtacttgtctaaactcacttctcctcattcttttattatactctatccattgtttaaatttctcaaacgcaacaagtttgtttctgtgctacattgtgcccaggctgttccctctataagaaacggtgattctcaagtggagacaattttagctcccagaggtcacgagtcaatgtctggagacatctgtggttggcaaaagtgggcagggtgtgttcctggcatctagtgggtagaggccagagatgatgctacgcatcctgcaatgcacaggatggcacccacagtaaagaattatccatccccaaacatcagcagtgccactgctaggaatcccagtatagaaggatctctttcttatttccctcccaatggatcccttcttgtcttctaggtctcggttcaaagctgaatattcagaggcctttctgacctcctgcttatggccctcgagtttttctccacacccacatcttcctttttttttgttgttttttgtttgtttgtttgtttttttgagatagagtcttgctgtgtcgccaggctggagtacagtggcgcgatatcggctcactacaacctccacctcctgggttcaagcgattctcctgcctcagcctcccaagtaggggggattacaggcacgcaccaccatgcccggctcatttttgtatttttagtagagatggggtttcaccatcttggccaggctggtcttgaactcctgaccttgtgatccacctgccttggcctctcaaagtgctgggattacaggtgtgagccactgcacccggcccacatcttccttgctttatggcttgttcacaccttgcatgatgtatctttggcatgatcatctaactccatcttctcagctaggatacacattccatgagcagaggagaagtacaggaagctgcatcacttttgttcacaaaatgcactacttcgaatgtagcacggtagttgctcagtaaatgtttgttgaacaaatgaacaaaattgtggtaagtaaaattctaccagcaatgttctataaccattcccgtttatccctctgtcttatggacaaaagaaaacagttgtctttctagtgcctgtcatttttctcaggttcaaggatgtcaggtgtaccccattcaaactgaccagagattgtgcctccccagtaccttctgcagtctagggtctcccagcagatggtgggatgcccccaagcctaggaatgaagaagacccccagtgaccaagctgtgaagaagaaagcagccacttctagctttaaagagaggtaggtcttccttccatgcttgtaccttgtttgggttctgattcaaaactcaaactcttgggaatatgtgacctagatatttgatgccattaaaacatgcctgctaatattttaggtataagcatcattgtgatgctgtcttaaaaaagagatcttatcttttctagatatatactgaaatatttatagatacaattctgtgatatcttatatttctttcaaaataacccactgttgggggaagaggatgaaagtccagatacaagaacaatggccatgaattaacctgggtgacatccacgtgggagttcattacactattctcttggtactcttgtgcatgtttgaaagttgccttaataaaagttttatttttttaggaccccttcatctaggtctcctgggaatgctgaaccctatggcctcatgccatcagagggaggaagatccccctcttcacccccatccactttccttttcacccttgtcagcaaatccagatggaaaacacagtcaaaggaaaaagctgccctctcaagagaaaataacagcctggcacgatggctcacacctataatcccagcactttgggaggccaaggcaggcggatcacctggggccaggagtttgagaccaacatggtgaaacaccatctctatgctacttcagaggttgaggtaggagaatcacttgaacctggtgggtggaggctgcagcgagctaagatcacaccactgcactccagcctgggtgacagagcgagactctgtctccaaaatatatatatatatatagatatatataccgttcagaatatcattcaaagtatcatgccagtggcttccctcttgcttggactaacagccaaattctaggatcaccacgatctggcctcaaattactctctgactttatctctcttgttatgctacccctcacttactctgttacagctccactgaaccctgctgttcctcgcacaggccaggcatggacccacctctgggctcagcccctgcctttgcccctgcctggaccactttctctgtaggcgtgactctctttttcatcttcttctgttcttatccgtgaaaaccttccaggccaccgttggtaaaattacaactgtcccctacttttgccccttactttatttttctaagatatcatttaacttattttgttgtttgtctccctacttgaatggaagcttgtgatggttactattgagtgtcaacttgattggactgaaggatgcaaagtactgtttctggccatgtctgtgagggtgttgccaaaggagattaacatttgagtcagtggactgggaaaggcagacccactctcagtctgggtgggcataatctaatcagctgccagcgtggccagaataaaagcaggcagaacgtggaaggaataagctggctgagtctcccatgctggatgcttcctgcctttgaacatcagactccaagttcttcagctttgggatctttgggccttcgaccacagactgaagactgcactgtgggcttccctacttttgaggttttgagaatcagactggcttccttgctcctcagcttgcagacggcctatcgtgagacctcgccttgtgattgtgtgagtcaatactccttaataaactcctctttatatatacacctatcctgttagttctgtccctctagagaaccctaatataaagctccacgcgggttggagtttccgtctgtttagtgcactggcatatcagctaatagagctgggaaaaccacgtgctcagtctctatctgttgaatgcatgaatgaatgagtgaatgaatcaatgattctcaggtccaatcagaatcctatcctgagcgatcctgtggagactatgcatcagtctccttctgcctcgtgagttcccagccatgaccagccagagcaggacgtcagacaagactggcttggggcccttggctgccttacctgatggggtagtcggccgcactcaggttgatgaagaagtcccagggccagtcggtcatctccaggaggtcccgcatgctctgcaggtaggtggacaggaggctggctcctccccagatggtggccattctccagggggtgacgcggacattgctgtactgcctggagacctggagcacttgccgatgcaggtaattagagcgcttttcccaggagagaaagggtgatgacagtcagtggcctagaaaatacccaggcatgcccctcacccctgtcccctctctgtgtcttccctcctggttgggcacttctgagcacagtggcctttgccaagtaaatgatcctggactggagtgtctttctgtactgcaattcaaacttggattattttttacatttcaaattagctatttgaaatgcagattcactggccgcacttctgagctaatggttcactaggcttgggctggtggtgcctgggacttcacatttttaaaattttatcttattttattttattttgagatggagtcttgctttatttatttacttagacagagtctcgctccgtcacccgggctggaacaaagtggtgccatctcagctcactgcaacctccaccacccaagttcaagcaattctcctgcctcagcttcccaagtagctgggattacaagtatgcgccaccacgcccagctaagtcttgtattttagtagagatggggcttcaccatgttggacaggctggtctggaactcctgacctcaggtgatccgcccaccttggtctcccaaagtgctgggattacaggcatgagccactgcacctggccaactttgcattcatatacatgacagctgcatggggtctgaggaagacaagctgggaaatatggctccatctaaacccatgtatatttcggaggcagaatttttgttttctgtccccactcctactgattgctcctccattatcctctcacaggtctgctagaagccgaccttttggacaagacttccccctttgccttcttgactaaaggcataattgtttcaccaatagaaacctcagggacaaggtagctcgggagtcagcagggctgatgcaggtttttgttaataaagttttattggtacacagccatgctcatttgttgacatgttctccttggctgctttagcacaagggcagtgctgagtagctgtgacagagactatgtgccctgcaacacctaaaatatgtactatcttgccttccatagaaaaagtgtacgcactcctgggatagtgatatggtttggttgtgtccccacccaaatctaatcttgaattgtagctcccataattcccacgtgttatgggagggatccagtgggagataactgaatcacaggggtggtttctcccatactgttctcgtggtagtgaataagtctcatgagatctgatggttttacaccgggaaacttcttttgcttggctctcatttttctctcttgctgccgccatgtaagacttgctttttgccttccaccaggattgtgaggcttccccagctgcttagaactgtgagtccattaaacatctttctttataaattactcagtctcaggtatgtctttattagcagcatgaaaatggactaataaaggtaagctattcccacaaagtatgtgagaggcaggcagagggcattgggtagaggggagaggtaagaaacagcatttaggggccgggcacggtggctcacacctgtaatcccagcactttgggaggctgaggcgggcagatcacgaggtcaagagatcgagaccatcctggccaacatggtgaaaccttgtctctactaaaaatacaaaaattagccgggtgtggtggcatgcacctgtagtcccagctacttgggaggctgaggcaggaaaattgcttgaacccaggaggcagaggttgcagtgagcggagatcatgccacggcactccagcctggtgactgagcgacattccatcaaaaaaaaaagaaaaaaaaccccccaaaaacagcatttatcatttatggacaaaattgtaagtcgcagctggaaactttgaaaccaacacacacatagagacagcactctagggccacacgctctgtggagaggcagctggtcagcttccaagccttttctgaaagcaggcagtctggactagcaatgcagaaggagggtatcagggagggacggacagaccccgaagaaagcccagcaaggggtgatcacagaggcctctcaccttgtccacgtggatgtagtagaagtggtctttgtggtagatggccttgaacatgcgctgcaactgccgagaggcacggccgtggaccaccaggacaaaggcgattctgaccgggttggctggcatgtactccacggagtcctcgtcccactgcacgttcttgttggctttacctggggaaaatccaagagaacagagaggagaaagtgaggctctgccatcctttgcaggggtgggaagtttctctggtgcttcttttggggactattttaggggcacagtcatcaaattgggccttaaaacataattcaatgccacaaagcacatcttagattctcacactgtcaggcacaaaaggggttaggggaccctggggttgttacgacatagtttccattctgaggagcttaaaaatgctggaagagacacatggacacatattaagctactgaacaaggcaggaggaggtgagagctataagagatgtatctctgaatgacagaggaagaagcagttaatttcgagttagtgaacgtaagatacatgtgttgtttttgcctgtccagaattcattctcccttcttctaatagcatccaatatattgtttgttttaacggtggtaagaacagatagcatgaaatctcccctcttaataaatgtttaagtgtacactacagtactgctgcctattaatacaatgttgtacagcaggatctttaaatttacttgtcctgcatgactgaaacttcatcatccaataccttttgtggcatcatcctcctctcctctattcttagtccatatgggtggggaagacctaacttcatcatcaatttcaggggtggacctacagcttaggcctggccaatgggaatgctgattctccatagccacagtattgtttagagatgaacatatgactcaaccaagttaattaaccaataagacagaatgctagacttttgttagaactactacataagagaggttatctttttttttttttttttgagacggagtcttactctgttgcccaggctgcagtgcagtggtgcgatcttggctcattgcaacctccacctctcaggttcaagtgattttcctgcctgagcctcctgagtagctgagattacaggcacgcaacaccatgcctagctaatttttgtgtttttagtagagatggggtttcatcatgttggccaggctggtctcggaactcctgacctcaggtgatctgcctaccttggcctcccaaagtgctgggattacagacgtgagccactgtgcccggtgagaggttctttttctgttacacaggagactagaagattctatgagcctttctgttcccacacggagagaggttgcctgagaagaaaactaatgtggagtacattgccaaggggggatgagggtccaggtgcttgtggcctgccttgagctcctgcatcagtaaggctacagatcacccactgtcatctatcatgttcttttaaatccaaatcctataccacatccacttggataaatagtcccagacatattttattccgaaaatcagcctcaaagactcctctctttctttctcttgcttcagataaaaacacagcttcctagtttagtttattacaatcccaactagaaatctcctagctttcctcagcctgatttcacttgggtccaacccaatttcttaagagttctgggtttatgggacccaggacattgtcagggtagtagctgcaagtgtcccagcatctaaaccgggagaactgagatggagactgtggggctgggggattaggacatcgggagtctaagctgtcatcagaaggctgaatggttgctgaatgaacgaggctctttctacgtagttccaggagacaagacaagattgacgtagataatatccaaatcacactacacagcctctatggctggtgtgatctaactactcagatctctctgccctcgattggtgggtctcacattccatcttgtcctctggccttctttctcttcctcaaacaagctcatttctgccttaggaccttctccctggcttcttgtgatctggaacgccctctccccagatctctgcgtggctgcatcttcttgtcattagttcacagtccaaaaaggggactcaccaccacctcttttactctctttcacctcacccgcacctcttttactctctttcacctcaccggatttcaactttcttcatagcatgtaacactgtctgcaattgtttatctgtttacttgcttattatctgaacacaccactagaacattagctccaagagatgaggggctattttggccttgtttaccacagaatctgcaacacttgaacagtatctgacacacatctggttctcggtgaaacaaaagttacaggaaggcacatttgggatcagtaaaataacaataccttttattgagcattgaccagcccttgacgttcattagataatttaatcctcgtaatgatcctacaaagtaatgctattatccccgctttccaaatgaggaaaccacagcttagaagaggccaagggattggctcaaggtcacactgctttaattagttaagctgagattcaaacacaggtctgattccaaagatcatgccctgaaccactaatacacaccatatgatcatacctagagtttggaaggaaaagtttataacaattgcttttagttgcttgttgctaaccaaatactttgtaagttagttattgcaggcaggtaggcatgcatttaaggactaacataggtattccagtatttctgtattagatgagatgctgattctaggtgattaataaggctgtatcttttcatccatccatctattcctccacccatccacccattaatttattcatcgatcgaaatccaaccactcatccattcatccatccaccattccacccatttatccatttatttgtccatccaaatccaaccactaatctgtccatccatctacccacccattcatccatccctccacccatccacccattcatccatttattcatccatctaaatccaaccacttatctgtccatccatccacccactcatccatccctccacccatccacccattcgttcatgcatttattcatccatccaagtccaaccattcatccattgctccacccattcatccatacatccatttattcatccatccaaatctaactactcatctgtccactcatccatatctaaccattcatccatccaagcatacagcaaaccctccaactatgcatccagcaaagcctccaagagcttatcatcccaaacaccatccatccacttaaggtgtatggggcctttgagattaacccttgcttttccctgtagccatgaacatcttttgccatagtttttgaatgagcaaattaatgaatgtgttctgaagaagagtggctgctctgatccagaggagctggtgtttcttaagtgcctcctatgcatccattgttatttgaccctgggaagaatgcgttatcatcctctgaggctcagagaggtcagcacatttcccaggtcacacagtgagtgaggacagaggtgggaggggaagctgagtgttgccgagtccaaagccagccctgatatttccacttgctctctgcagaagtggagatttgcgatatagaggataggtgtaaggactctatgctggtctttaaaaagggcttggatgttgatgctgaggtcttttacaacttctctttagagttttaaaaggcagaacagatttacagacagacacagacatggatgcttttcttttggagaaagggcagagtcctgtgaaatcaaagacaaatcactccagcaagagagctcccttggcttaaatataaagtcatctttgggtcagacagttagtctggggagctgcaaagagaatggggaacaaaaaacccagagctcttctgagtacagctattctggggaaggggtgggtgggaaggaacaaaaatatctaaagaaaggagacatgcagagaaggagaaatagagatgcggatggggatggggggcagagggggaagacagcgagtcaggagaaagatcaaccatttactgagtgcctactatgtgttaagcaatttctgtgcatgattttattcatttctatcaaaactgctatgaaaacagagctattatctttctattgtaggcacaaggaagctgaggcttggagaggtcccagttataaagtagctgagctgagaatggagtgagtctgtgatcccagagccctgtcatggtcaccatgctcaatcaaactgtcctcatttcaaaaagaggaaaatccgtccctagaggaaatgtgtcagctttcagctgcaggacagatataacaatgacatgtggtcagagctatgtgggtctttatgaacacggaactctttgaaagaccaaaacccaaacagtgcccagctccaaaaaaaaaaaaaaaaaaaaaaaagaatttaacaatgtaatcagattcccatggcacaaaacagaaaataagtggaaaaatcagagtgattagaggcagcaggagaagctgacttcagatgaatgttaacaagccaggtttatcgagagagaatatcaagtatatttttgcagtgcaggtgtgaaggctgaggatgatggggggtcccggagagctcccccagtagatagctgtgctgtgttagttctgttactcaaattccctatttcttagcagcattgtgggtcaaacgaggactatgtaatccttgggctccaaagacatagcagagatgaaggtgctttgcaagggtcaacatgctgttccactgttgtggtgctggcaaagatcatgttagcagtgtcctgcaataatgatttgggaggagaaagcaaggtgcaggggtttagaacatgacctgtggtcaggcagatgtgaatgaccttggaccttttatgcaatctctccaagccttagtattctgatctgtaaaatgggtatgtataatcacagaatccaccccacatggacattcacatccagaagagagagcacagtgcctggcatctagcaaatcctcaataaattatactgtcatagccatcatttctatgtggctgctcatccacgatgatcaggatttaaccaacaggcccagctccagagttctacctcaaagctgcactgactcccagggctgtgtgtactctagagcctgctgcttgtaaataaacatctacaaccggaatttccctctgcagcgtatgcccagaccacaattaataacaaatgtgaaggagctgcttgactggaatagttactctaccaacaaagccctcgattctatttatactctgaaagggctgcttccggctgctgcaaggggcactttctgacttacttccaactaagagggttagttgggtcttgggaacacagagacatggaaacaaggttgtatgcaaatgaggcttgggttaggaagctcccagctggagcccagcttctatgctgcctgggaaggtgtgactgggattcagagctggggtgtagaatgcaaccttgcactgtgtggatttaggaaagacaccgcccctctctgattgtcagttcttcatttacaaagtgggaagagaggtccatctctgaccccgctgggttccagggtgattcatgatcacagatgaggaaaagtttcacagcggcagcaggcgcgttgcagaggagcgggattcgtcttactgggggagaaaacctgcacgctcaaggttctttgttagatctgggtgggagatgcctttatcctagtgggaaattttaaaagaggttttctggtgattaaacttgggagctgtctggtgcccagaaagaatcccctgctctcgatgggtttagaaaaggcggtgctgtgtggcgacaagcatactggataaagagcaacgaggtggattcaaattcctgcttctgctgtgaaccagccacgggggcctgggcaagtcaatttctttccttggtcctgtagaatctcaaagactagtaacgctatcagatgcatgtcaaatacttatcatgcttgcgtcaaatacttctcatggtggcttgcgtctgtaattccagctaccctggaggctgaggcagaaggactgcttgagtccaggagttcgaggctgcagtgagctacgatggtgtcactgcactctggcctgggtgacagagtgagaccctgtctctaaaaataaataaatcagaaataaacaaacactcattatggcctaagcaccagtcaaatgtgatctcattatttaattgtcccaaggtctcaggaggcaggtgccatgttagcagttggtgcgagaatggaaaccaccacttgggtgtgccagactccaaaacccctattttggaaaaacccaaatgagggagatgaaatttctggatatttctggaaatttctgaatcatctggaattctaacccgatccaggagttagcattgccacatagagaactgtactcccttgagagtcaggttggttttcttttctttcttttttttttttttttttttttgagacagagtttcactcttgtcacctaggctggagtgcaatggtgcaatcttggctcactgcaacatctgcctcccaggttcaagcaattcttctgcctcagcctcctgagtagctgggattataggcacctgccaccacgcctggctaaattttttgtatttttgatagagacagggtttcaccgtgttggctgggttggtctcgaactcctgaccttaggtgatctaactgtctcagcctcccatagtgctgggattacaggcgtgagccacagcgcctagcccaggttggttctcttgatacctgtcagttcgttccctatgagccaaggtcatgctcttatctcttgtaggatgccagccttgcccctggacctggtacagagctaagtttgggggagaggcctcaatgaatgatttctgactgacagatttagccagacagcttcatccacatacagggtcccggtggtggggatgagggggcaaagttgaagactcaggcctgagaggttgcccatggctgtctcctctcatccagcaaactggatggaggctaggcacccccacttttccttgaggcttttgggtggtctgtggacccttgctcagcagcaccaagccctgctgggaggaatcagtcaacggcccagactgctctgcaccgcagctgctgctcatgcggggccaccaggtcccctcccacccagcttaatgagaagagaggggtggaggggatgtgaactgggggtcatggggtccacagaggggagctgaaagaacataggtccaaggatgaaggtggccaagccagcacctgtcaggtctcaggagaaatgacccttccttgggaagccctccctgactctcttccccatcccttcatttaaaaaatatttttaatgacttttttttctttttctttttcagagattgagtcttgctttgtaacccaggctggagtgcagtggcatgatcataggtcactgccacctcaaatttctgggctcaagggatcctcacacctcagcctcccaagtagctgggactataggtgaccaccaccatgtgggctaattttgaaatgtttggtagagacagtgccttgctatgctgtccaggctggtctcaaactcctgggctcaagcaatcctcccttagcctcccaaagtgctggtgttataggtgtgagctactgtgcctggcccccatcccttctttgagttccctgtcacagcccctctgaacatcctgcacttctctttaaaaaaaaaaaaaagttgtagtccaagataatacatgctgagtatcccttatgtgaaatgcctggaaccagaagtgtttccaattttgaattttttcagattttgaagtatctgtgtatatgtaatgagatattttggggaagggacccaagcctaaacacaaaatccatttctgtttcatatacactttatacacatagcctgaaagtaattttatacaatattttaaataattgtgtgcattaatcaaagttgcattaagcatttatgtatagaattttccgcttgtagcattatgtgcccaaaatgttctggatttcggagtacttcagattttggatttttgaattaaggatgctctacatggataacatataatttactattttagccttttttggttcgagatggaatctcactgtcacccaggctggagtgctgtggcacaatctcggctcactgcaacctccacctcccgggttcaagcgattctcctgcctcagcctcctgaggagctgagactacaggtgcccaccaccacgcccggctaatttttttgtatttttagtagagatggggttttgccatgtcggccaggctggtctcaaactcttgactgcaggtgatcagcccaccttggcctcccaaagtgctgggattacaggcatgagacacatctggcctattttaagcatttttaagtttacagtttagtataataaatatacttacactgttgtgcaactattatcaccatccatctccagaactcttttcatcttgcaaaactgaaactttctatccattgaacaataacttcccactctcccctccttcagctcctggaaagcttcattctactttctgcctctatgaatttgataaggaacctcatgtaagtgacatcagacattattcttccttttgtgtctggatcctttcacttggcgcagtgccctcctggtttgtccacgtcgtagcctatgtcagaatttcattcctttttcagggcaagtaatactccactgtatgcatatagcacaattgatccactcatctgtcaatggacccttgaatggctttcaccttttggctgttatgaataatgttgctctgaacatgggtgtacaagtacctgtttgagtcactgtttcaattctttggagtatattcccagaaatggaattggtggatcataaagtcactatttgtaatgttttatttttaggagcccatcctgcacttcctaactcagctattccacagaaggggttagcctgggtctgcatcccagccctaccatttattaggaggtcactttgcctctcatgcctcagtttcctcatctgtcaaagagaactcacctctaagtgatgctgtaagcacagctataaatgaggcaaaataaagccatacagcctgattgtggaggagttcatgtggtgtgactccgcggacctcgcccatcacacttgaacttgtaactaatcacatggctggagagtgtttaacagggacctgatcctgaggactatagcgattgtggttttgtttttgtcttttttaaattcgtaagacgggatctcgctctgttgcccaggctggagtgcagtggtgtgatcatggctcactgcagtctcaaactccaggctcaagagatcctcctaccttagcctgctgagtagctgggactagaggcatgaacaccacacctggctaattaaatatatatttgtagagaccaggtctccctatgctgctcaggctggtctcaaactcatgagctcaaatgatcctccctcttcagcctccagagtagctgggaccagaggcatgcatcccatgtccatctaatttttttagaaaaattatctgtaggctggctgtggtggctcacgcctgtaatcccagcactttgggaggctgaggtgggtggatcacaaggtcaagagtttgagaccagcctgaccaacatggtgaaaccccgtttctactaaaaatgcaaaagcaggtggataacaaggtcaagagtttgagaccagcctgaccaatatggtgaaaccctgtctctactaaaaatgcaaaaatgagctgggcatggtggtgcacgcctataatcccagctactcaggaggctgaggcaggagaattgcttgaacccaggaggcggaggttgcagtgagccaagatcacaccattgcactccagcctgggtgacaaaatgagactccatcttaaaaaaaaaattatttgtagagataaggtctccctatgttgcccaggttggtcttgaactcctgggctcaagtgatcttcccccttcagcctcccagtgctgggattacaggtgtgagccaccttgcccagtgtgttcttaaatgcgatgtcagagttacccaagagaggattcacatgctgctcacatcgaatggcattgagtcaggggggactgtgaatcttttttcaattcttacccacctctcctgaataccctaccagcaaactctcaggtcaatgcaaacaaatcttcagcagcactcccctactgaacttccttttccaaaaagcagaatcctgcccccagaactggcatctccagcaggtaacaggagtgcccggctagcactgaatgccattgtttttgtttcactgatttcttcgcattgttgctgtctcctcatggcaagtgacagcaagatttccacttatggccatgatgcaaaattacttttaaaataaaatgtgcttacataaaaataaaggcgagtctattgcagtaaaaatactacaagaataatatggcaggtggaatgtggatatggcagaattgtgaaggctggagggatgcgaaggaagcttggggaatgttaattaggctccatgagctttgcttccaaactaggatgtgctgagtttgttaaacaaatgagaggaggtaaaggcaaagggcagggggatactcaagcagccccatccatcctgcaaggacccaaaggtccagacaatgttttgatctttctggatgagggctcccacttgctttaggggcccaggagggtttgtcaggagtctcctggggtgggcttttgggacagcacctccctgctagagagacagaagtctgtggagaaacactgtccttttgattcttactctaatttgttgagtacttaacattcatgtggttctttcactcatgaggcttttacctcttgtaacaatgctgcaaatgaaaattatccccatttatagataatcatcccaggctcagagagggtgaggaacttgcccaaggtcacagagccaagaggtggagaagaaattaggatacgcactgttctgacgtcaaataccatgctctatgaccaggctttggctagcaagaatctggcatcctcatcttcactcaggctcccatgctaagcttgatgggaaccaaagcctcatgttctcagaatggcttcaaaactatcgtctcccctagagcaagatttctcaaccttggcactattgatatttgaggccagataattccttgttgtggaggggactgtcctgcgcactgtaggatgtttagcagcatcgctggatctacccactaggtgccagtagcactcacctagttgtgacaaaacctaaaatgtctccattcattgatgtgtgtccccctggtgggggatagggcgtggagaggcaaaatttgctcccagttgagaaccactgttctaggacaagctctctagatgtggtctctgatgagcagcatcagcaacacctgggaatttgttagcaatgtaagtttcagccccaaccccaaaccttctgaatcagaaactctgggtgtgggagacaaggactctgtgttgtaagaagctctccaggtgattgtgatacaggctcatgtttgcctaggccagtggttcttaaccctggctgcacatttaaaatcatctgaacatcttttttttagaaaaacatcttcatgcctcggccccaccccaataaattctaacttaattagtttggtgggcgcaagtattgggactcttttgaaactccccctgtgattctgacatgcagtcagggttgagaaccacattttggacaccttttcttttcttttcaaccatcttttaaaaaacgcatctctcgaggtggaaagaattttacccaaacatatctttggctgttgcctcaaatgctcatggccactcactccaccagagactgaaggctacctcattcattatttttctcccactctgagaaaatgtctccctccacccccgaccaagcactcaggacattttcctgctcactgacttcccccgaccccattcaagtctggagttattaaagaacagcccatgactgaaccgtcttattgattttattgttcagagccctgggatattctaatgatatactgctcaataaatggaaactggtgggatagatattgacggtgtatggtacatttcactgcaattcactgggtcccagtcacttggcctgtaacatatcatctgtgaaaacgctgcgctgtggcctgcaagctcttatccatcctgctgatgttaccttttctgtgcatcaaggatgaaagagctattatgataatagcaatgtggccactgtgtgccaggtcctgggctgagcattttctaacagacttgatatggtttggatctgtgtccccaaccaaatctcatgttgaatggtaacccacagtgttggaggtgggacctggtgggaggtgactggatcatgggggtggatccttcatgaatggtttagcaccattcctttgatgctgttctctagagatctgcgtgtttaaaagtgtgtggcacctcccctgtcttgctcttgttccggccctgtaagacatacctacatccccctttaccttccaccacaattgtaagtttcctggggcctcctcagaagcagaagccttgatgtttcctgtacagctcacagaactgagagccaattaaaactcctttctttataaattatccactcaggtatttctttatagcaatgggagaatgaaccaatacaagaccttacctcatttactcctcacagcagacctttgagggaggcattctgactattcccattttacagataaggaaataaagactctgagtagttacctgacctggtcagctaatatgctgcagaactgggattcaaccctccatctgtcagacactaaaatggggacttttaacccctgagcttctattgtattggaacaacctttcttttcttttcttttttttttgagactgagtctcgcactgtcgcccaggctggagtgcagtagtgaggtctctgctcactgcaacctccgcctcctgggttcaagcgattctcctgtctcagcctcccgagtacctgggattacaggtgcccacccccatgcccggctaattttttgtatttttagtagagacagttttcactatgttggccaggctggtcttgaacccctgaccttgtgattcgcccgcctcagcctcccaaagtgctgggattacaggcatgatctgccgcacctagccatttgagcaacctttcagagggtttcagcacagatcaatatttcacagatcctcctcccttctcaagcagtatttctcaacagggactactgtcacttgggaagagacaattctttgagtggtattatcccatgattacagggcatttgaaatccctagtccccataacagcctctcctcacttgcatttcccagtgccccctaggggaccagcatggtttgagaaccactcatctccctgggaggcagaaggcttcctgccaagatggcctcccactttttggcaaacacaggtagccactctggaaaggctacatagcagagtggaaagaagtttcgttttgaaatcggacagatctgcattcaaaccatggctcttcccccattaactctgggaggtcgggcaagctatataacctctcaaagattctagctcatcatcagtaaaatagggatacatattgaccctccttcatagggaggaactgatggatggaattatgctcagagaagtgcctagtacagagcagtagctctgaacctggggcattatgtctttcccctgtctcctatgtgctctttccaaactcctgatccatagaatccaagagcataacaagtgatggtgttttacgccactaagtttgggggggtttgctacccagcagaagtaactggaacgaatgtctatgatatgccaggcaggcaccattctgggagtgaaaaatagactcatgcacacgccacaagagcttttgcttatgagaagcagcctctcctgagaaagaagacagataataaacacataaatatctccaggaccagtatgtggtatgcagaaaatgaaatggtggccatcattattgttgccttaaataatgatttgcaaatgactacattttctcttctcctctttccaacctcatttccctctatgctcctccaatcaccctttctgtgaagccaaaatgttgtttaatctcacgaaacctctgcttctgtttctcgatgctgaggtatcctttccttttccaaagacaggatttgctaggactgaatcgtgtcccccgaaaattaatatgttgaaggcctagcctctcctgtgaccgtattggagatgtggcctttaaggaggtgattaaagttaaatgaagttgggccgagtgtggcggctcatgcctgtaatcccagcactttgggaggccgaagtgggtgggtcacttgaagtcaggagttgaagaccagcctggccaatatggtaaaaacttgtctctattaaaaatacaaaaattagccaggcatggtggtaggcacctgtaatcccagctactcaggaggctgaggcaggagaatcacttgaacccaggaggcagacgttgcaccactgcactccagcacgggtggcaaaacaagactgcctctgaaataaacaaacaaacaaaaaggttaaatgaagtcctaagggtggagccttgaatttaggggatttttgctcttagaagagacactggagagcttgctatttctctgccacatgaggtcacagtgagaagtcggccatctgcaagccaggaagagggccctcactagaacccaaccatgctggcaccctgatctcagattcatagcttccaaaatggagacaaatatttgttttttaagccacctggtctatggtaattttttttaaatgatagcccaggcagactaatatacaactcaaggaggccagggatgtgccccttagactacaattgacaggttgagtgaggagttaactaggtaagagaagagggaaaagtgtccctaagtggagggaacagcatatgcaaagggcctgtcacgaatgatagtatggtaaggagaagacatacaggaaggccagtgtggctggaactgaggccaagaggaagtgcagaagatgaggatgggccgacagcagaggcatcacacagggtcttgggtaccaccttaaggactgcaattgaagagagtaacaagccctttcatcaggcttgttatccatggttgaggagtgggtggcaggcaggacacattttgaaattcccagatggggtggtgtgggatgccttgcttcatggggtggaaagacaggcaggggcccccatatcctgcactctgtgcttcgtgtgtccagaaagcctgctctatctgtactccctgccctcttgacccagaggctgctgtgtgcaagttctcctacgagccttcctgtcgcttgacattttcatctctgccctcgtttctcctctcttgaagggactcgcaggctcaataaatactgccatggaaaaacgcagcgactcatctatttttattacaaatggagcctctcgaggagggaacaactcttatttacttctcagagggagggttttgacaacaggtttattttctccaactctccaaggattaagtgagtaacactctaaagttaacagtacattaattaatgccaaattggttggaattttcctaataaaaatcctcatagtaatcacattatgggccattaacgctgcctcctgatcataaaccataaatatgttctgcaggtgccttcttttaaaaaagggacatttctccaaatcgtttcccatttgtcacattaatgctgtcacgtcacataatgcagacaggaataattataaaagctcatgtgggtaggatttactttgcgctggtcactcggccaagccctgtacacatatcatctcattgagttcttgcagcaaacctatgaggtcctgctatcattctcattttacacatggggaaactgaggcagacagaaagagtgtaatctgcccatgatcaaatgctagcaagtaatggagctaggatgtgagtccaagcaaactgattccaggatactctgtcatcctgcctcttgaaatataaggactacatctctaagcacagtggtcctcttcgtcaagcctactgctaatgaaatctccggttgatcacaacagcaacgagcagcaatagtcaacacaacatttggttttgctcctagagggcagggatggtgtttcatttacttggcctaggagagtgtctggtgacaatgccaggagcacttggaacatacagtaaattcctgttgaataaatggacatagaaacacacatgcaacagggttcacaacagtgggtaacaacgagcacctcaaatgcactgggatctcaatagatccctctccctgcaatgatgtgagctgggctcagcctcaggccggggctctgatacacagacaaggagaccacaccacttggggagctgcagttcctgggagaaaaccaaggaggacctcgtttcgaactctgttctagcttcacttcttaggtgcttctgattgtttcttggatttctctgtctacaaagataatacttactgtagaaaattcaagcatacagaacaatatgaagtaaaaaaaaacccagatattagtgccaaaatatcaccattgttaacaaacgttcagtgaacattttgcaaatagttttatgcactcacgttatatataatcatgtatgttctgctttgtcatatgcattctgttttcagtaatgtactcctgacatcttttcactgtcagtgaatacaggcattctctctttccttcctcccaccctcctccttcccttctcaaatgttcacagagcagctacgctgccaggcactgagaatgcccaaatgaacaaaaccagtgttgaatctgtattcaaggagctgacagtccagtggatgttggatggagaaaacagatcaacgtattttacaaaaggtgttggatgcaatgaatgaaaagtacgggcggccaggggaggagagagatggggccaggtgatctgatgcaaaccaggtctatagacctttccaaagaagccacggtgaagctgagctgtgaaacataaagagtgagccaggtgaaaggatgtcactttggaaggaaggaagaccatgtgtcaaggtctcaaggcagggagggtcttattttgaataataataataataaaaaaaaaaaaagacaaaaaacgttgggggtccaggcgcagcggttcacgcctgtaatcccagcactttgagaggtggatcacaaggtcaggtgttcgagaccagcctggccaacatggtgaaacctcatctctactaaaaatacaaaaattagccaggcatggtggtgcgcgcctgtagtttcagctactcgggaggctgaggcaggagaactgcttgaacccagggggtggaggttgcagtgagccaaaatcacaccactgcgctccagcctagtgacagagtgaggcttcctctcaagaaaaggcaaaacaccaaaaaaacaaacaacaacaacaagaacaacaaaacaaagcgaaaaagcaaactcaggggtggggagaggggagtagtgcggacttttgtttttttttttactttcctttggtgcttttctgtatttttaagacttctgtagggtaatgacaagaacttactgagtaagtaattcagggccactgggtattttttcttagatgcctccaaagatggaaggctcagtgccttacatagcagggcttgtgctcagcagtgattgtgagctatcgcttccaaaatgtgcctgctcgaagctttcatccataggtcctaatttggtcttcaaagatagtgctgctgcttctctggcaaaccaacctctcaaatatgtggaaattgttattttgctattactccggcccccatctccctccaaatctaagccacctgcatattccaagctcattcaatttctctcctacaacatgtaaggtctctttgtcatgtttcttcctgggagtgactagaagatcctccacgggcacagcctgagatcactgtaaaaactttgaaatacctcccaagcatgtgccagcacaaagtcatttgttcatttgatgaataattataaatgcctgtgagtgtgctataccctggggcagtggcagggggcagggtgtgaggtggagggggaagacagcagtggacaggatggacttatcacttatttgagaaataattatcggcagggcatggtggctcatgcctgtaatcccagcacttttggaggccaaggtgggtggatcacctgaggtcaagagttcaagaccatcctggccaacatggtaaaaccctgtatctactaaaaatacaaaaattagctgggcgtggtggcacatgcctataatcccagctactgaggaggctgaggcacaagaattgcttgaaccaggaggtggaggctgcagtgtgctgaggtcgtgccactgtgctccagcctgggcgactaagcaagactttgtctcaaaaaaaaaaaaaaaaaaaaagaaaaagaaaaaaaaagagaaataattatcaaatgcctgctactgggtgacacactgcagggctgcacactggaccagatggacatgataggcgaatctctaaataaatgtgaaatgaatgaacgctacatcttgtcttttaccattacagcatcattgaggggataaccattatgctgtcttggtgcttgtattaatcgagtcaagttccctaacattggtttgagagctccaggcaggtcactcttcgacctacctggaagaccagagagaccctgatttctcaacgatggcttggaaacttcatttaagccagggggctcctgagaatacttttcttttctttctttctctttttgagatggagtctcactctgtcacccaggctggagtgcagtggtgcgatcttggctcactgcaacctctgcctctgggttcaagtgattctcctgtgcagtggctcacgcctgtaattccagcattttgggaggccgaggcgggtggatcatttgaggtcaggagttcgagaccagcctgatcaacatggtgaaactccgtctctactagaaatacaaaaaaattagcagggcgtggtggtgcatgcctgtagtcccagctacttgggaggctgaggcaggagaataaacttttctaaataagaacctctctgaatgaactgacagaggaagctcattttaaacatgagctggcccctagaccagagaactgcaggggaaagtgggtgggtcctaggattttttgacaggatgcagttaagataagcctttaaggagacagaacgtgtgctaccacagcttgggaaggccactgacagtgaaaacaatttaaattaaattaaatttagtcagctccaaaaggaaacacatgtaatgttaatttcatgggtgtaccaatgtgtaaacctaacagatgatacttaaatgagaaaggcagagaaatgacatttggttaaacaatgcatcagtgggtaggatttgttgaaactgccatttaaaaaaaaaatatgagcacaattgaaatctgagcaagctgtcacccaggccaggccacctaggcgttctcatataacacacttgagagaagcagtgggtagccgggattggaggcagtctggataaatttggggaactcaggtcaatgtctgtgttaactttttgtttttgtttttgagacgtagtcccactctgtcccccaggctggagtgcaatgccgcaatctcggctcactgcaacccctgcctcctgggttcaagcgattctcctgcctcagcctcccgagtagctgggattacaggtgtgtgccaccacactcggctactttttatatctttagtagagatgggatttcaccatgttggccaggctggtctcaaactcctgatctcaggtgagtcacccgcctcggcctctcaaagtgttgggataacaggtgtgagccaccacgttcggcctgtgttaacttctgatgctcttcctgggcttgtttgcctgggcagataaaatcatttgcttgtctctccaactatgactgagatctcaccctgggcagaaagtgcgcctttgcttgtttatgtccttttcttaaaagcaacagattgtgtagtattggaggtacatgaaaatgtggaaagattggctttctgttttatctctgtcccttggcacaaaataggcactagggcaataaatgcagaatgagtgagtgatccagacactccttggccatgttttccacccttacggcttcatggtggcaacaacatttccttgcctcttgttaataatcatcacctcctaacatattgtttggggtcctcgtccctctccggcagccatcactccttttcaatattcacagaaccatgtcctatagtcaataaagctacgggaagctgactgattggcaaaaaacaggtctctactaaaaatgctaaccccagaaacaatgcatacacactgaccctgccagaaatatattgacaaaagccagcatttttttaagcacttactatatgccgggcatggtatcaagagtgttttcggttggttggttggttggtggcaatttttccagttcatcgtctcaaaacactgagacagatgccatcattatcccacttttgccaaggaagaacaggttgagactcaagaggttatatagcataaccaagatcacacagctagtggccaagctgggatctgaacccagactaacctgcttccaaagccattactccaacctgccttaaatgtattaagaatatgttttaagcagagtgtggtggggtgcacctgtagtcccagctcttcgggaggctgaggcaggaggatcgcttgagcctgggaggttaaggctgcagtgagctatgatcacgccactgtactctaacctgggcaacagagtgagaccttgtctccaagaaaaaataaaaagaacaggtttcagatgacttataagagaggaagttgacagttcctttgtgctttacatagagcactaaaatccagtatgagccagggcaatgctgggctcaacacatggatcccaaaatcgcagtggcttgaacccaacaaaggcttatttcctgctcctatgcagcttgagcagctctcctacagggccgtcctccaagaggtgacttgaggatccaaattgcttcaactacacaatcccactccttagcacccttctcttgcagtgcacagagaggacagcgattggcatgacaaattcacagcccgtcaactggcttggccaagaagtaaccatcatttccactcacgttcctctgagggagactgaatcctaggacccgacccagatacctgggagttagtaatggagagaagaacatgggtcctagaggaacatttatattttatgtcacagaaacatactaagttatgccctaagccagcacttcttgaccagggacaattttgtctccctgaggacatctagcaatgtctggagacatttttatttgtcacaactggaagaaagaatgctactggcacctaggaggtagaagccagggataccgctaaacgtcccaccatgtacgggacggcccccacagaagggattatctggttcaaaatgtcaaatgccaaggttgagaaactgcttgaaacccgtgatcctgaaaaagattgtctgaggagcttattaaaatgcagaatctagaccgggcgcagtggcttacgcctgtaatcccagcactttgggaggtggaggcgggtggatcacttgacgtcacgagttcaagatcagcctggccaaaatgacgaaaccccatctctactaaaaatataaaaattagatgggcacagtggtgtacacccataatcccagctacttgggaggctgaggcatgagaatcaattgaacccgggaggcagagattgcagcgagccgggatcgtgccacagcactccagcctgggtgacagagcaaaactctgtctcaaaaaaaaaaaaaaaaaaaaaagaatcctgcattcctccctccagatcaccaccctggcagtatttcagtattttcaggggccctctggcaactgtgacggccgctcttcgtgaaccacactcagggaaacctcacaggaaagaggaatcaagaacaccaagcgggggctgggactaggcgctgatgaactcacacagagacacccctcaaatgcttcagggtcagtgtgaggcaactgcgccaggaaaaaaaaaaaaaaaagaaaggctgacatttgttaagtgcctctctctgtctctttcgtgcaagccttgaattgcagggaacatattctaagactaacctgtcagccagtaacaactaaattactaaccttgcctcccgctgtgccccgtatccctgtcagatgcacagtcgcactcacagaggaatgcttcctggagatgtgttcccagcattggggaagctgacccttttgcaggaacagagccacgtggtcacatgtatttcacaggggccagggggctggaaataacccaaaggaaagggaagcaactctgggcagagcagtagggcaatcagagtggttgaggctcttggtcaaaaccacgtctgctttattcatggcactcactacaacctacttcacatcgtttgcagtcaggtcttgccaagaggctgtgctttagccaataaaatagaaatgtgatgcacacaacttctaggcttacccatggacacctgtgcatgcttctctgtgctatttccctcttcactgtctgggtgcagaagagcacggtgaccttggatgctgtgtgttgaagatagtggagatagtggagtcagatggaaagggcctggatccctgaattacaacatggaggggagtcaatcaggaacatctattttggatggcagaggatgaagacatcaaccatcttcatgttagagacattatacactggtggctgtgttccaataaaatttgacttacaaaacaggtggtgggctggattcagcccactggctacagtttacccatctctggttgaagagaagctctatctaccaaataaagtactagtcttccagaaagagttatctgattagacagtttgccctgtgtgacctcaacgcaaacaaacattgctacgtttgattgttatagcagctgatgttccctaactaatatagtgattctatacctggttactgaaggcagaaaggcttgggttcaaattctaggaccagacctcgctagctctgttatctagagaagctaccagaacctttgagcttcaatttcccaaagtggaaaatggaaaggaaatactgaagaaggtaacctgacatattttaattgaaggctgtggtatattggtcatctaggagctgttgtacagatgttctgattgttgaccacattctatcagcgacaagacggacaggaggaaaagcaaggcattgagatgggtgaaggtgaaccatttacaaagcctaaactttccatacatttcttacatgaacaaatgaatgacccaacgaacacttttagcagcatctgccttctatgaagaccaggcacgtgcatgcctaatcaccctttgggggcaagagccatctgtgatttggcttgttttctttcacagtcttatttcgcagtcttatcagtgtatctgtgcaaaagattactcagtgtacgtgcacttgttagcagatgcagggaagctatcacaatttagaaagcacgtgctttatactttcaagtcaggcttccctctgcgtcctggctctgtcacttatttgatctgtggtcttgggcaaatggcttcatgaactcttgaagcctcctcagcttccaaatctgcaaaaggggtatgccagagacagctaaccatccatcaacatccattttcccctctgttatacacaattacaaatgagaatgtgacacttatcaacatttcttcaacacttctcagcctctcttgtagcgaggtgcatgaggctctccctagattttaagacaggaatcttaaatattttattttctataagaggacagacagtaaacactttgggctttgtgggccatatggttctctgttgcaacttctcaactctgccactgtagagagaaggcagccacagacaagaccaaaacaaatgagtgtggctgtgttccaataaaacttaacttacgcaacaggtggtgggccggatttggcttgtgggctatcatttgccagtccctggtttaacagatgctcagcctaccaaatatagtattagtcttccaggaagagtcatctgattagacattttgtcctgtgtgacctcgtaagccaccaattcttattttacacacacacacacacacacacacactctctctctctctatttataattggtctgtgtctctgaaattctcatcatgttctgaaacgtcaactgtttcctgatctttaatcccagtctccatgggccatgtccctctccctttcctcctcctttttaggaccaactccataatttgcagggctcactacagatgaaaatgcaaggccccttgttcaaaaaatattaagagtgtcaagacggtgaaagcaaagcataaaatctaacatggggctttctgagcatgagctcaggttacaaagtccaccaagcagaccctgctggtctggcttgtattaccatcagcaaacccagaaagttttctgcctaatttcttgacaagtccagaaacttgccacctgcgagctgcttgaagcgtttcaggaatggttttgcacatcacaagaagaaggaggaaaaaaaaaaaacccaattttcttttagtatattacttgttagacagcgaaatggaatataattatggtgtgacatttccaacagcaaatatgttccagtgtaagcaattaacaccggttcttttggcaggcttaaaaagattactcagagactgtggtaagttacaatgccccatgaatcataaataatgtagaatcgcagctaagttgcattctacgaccaaagttcaaatttcttgatgaaaataaattgggtgcttttaaccctctgttgacttcatgtggcttaagcagattcggatcataagttctttggatttttgtaaattacatatttaccttacccctaagaacatctgcaaaaaattataaaaaaaaatctgcatgtattcatttcagctgctggaaatttgcatgaggtagtgggtttgaaggggacccctccaggatggacagaatgggggagacggcttacactgagaactattatccttggaggctgttatggttaaatgatgaagtcccaagatttagtagaaggcatatctggacctatgtccctattctctctgccattcttgacacaaccaaagggaaggcagcaccttctgaatgtatttgtgcagcttgtgactctgagcaactgaaaccaatgaaacaccagcagcagttacagagccacataccgtagggacattcaaggccaccgttacattcaaagcctcagggccgtagtacccttgtactatagcactactagcactatgggctggataactctctattggaggtgacagcaagctgtcctgtgcattgtgcagtgcccaggagcatctctggactcgatccactaaatgccaggagcatcctttctttagttgtgaccattaaaaatgtttccagcaggcacagtggctcacacctgtaatcccagcactttgggaggctgaggcgggcagatcacctgaggtcaggtgtttgagacaagcctggccaacgtggcgaaaccctgtctctactaaaatacaaaaattagccaggtgtggtggtggtggtagtgccagctactcaggaggctgaggtgggaggatggcttgagcccaggaggcagagattgcagtgagccgagatcacaccactgtactccagcctggatgacagagtgaaaccctgtctcaaaaaataaaaacgaagtttccagatattgccaaatgtccctggaaaaaaaaatactactttagatagacctgggtccatcactgtgtggccttgagcaaatgacttcattgctttgagcctcagtttccacatgtgcaaaaaaactcccatgcctaccttacagagagattgtgaggctgggatacaatgatgcagatagagcgcttagcctggtgtctggcataaagcaagcattcagtaagacagatgctatttattccatcacccatttgattgtttacaaacagctcctgagcacagtggagccatggcaggtaccaggggtgtgaagacgcataagccttatctctgtctcagacatgctaaccaacaacgtcagtgcaagggggtgctccctaaaatgaacacctggtcatggggcaatgggggcttggagaaaaatacctaaatctcgagacttcatggacaggatggcacctgagtaaagtaaaagttttccaggcagacacacttggggaagggcattccacacagaggcaactgcatgtgcaaaggtatggtggtatgagtcactcagaactcccctgagctcaggacggctgggaggtgaattctacaatgcaggtaagggaggaggagcagcaggaacaaggctggcaggcagagggcagatgaggaaggatcctgagatgtcaaatagttctcatctctcttgtcaacccaatgaactcatagcaaagctgagtccaaatcctgccttgcaggacgcaatgcagtgattgattagcaatgtctgctttggcccaggaaggtagaagaggctcaagctgcaatgtatttccttgtttgatgagggttttcatcaggggagtgatgtgaggagaagcacattttttaaagctcactctggaagccatgtttttttgtttttgtttttgaagagaagacagaggcagaaatggagcaggagaaagagttgggaagtgactgtaatactaccagacagagacaatacatgcctaaagggcagagcaggaggctggggaggaggagacagatacaaggtatttaggacctagaaatgatagcgactttgtggatttaagggagtagaaataacagagactcttggatttttggtttgggcaacttggggaataacagggttattcacctaggaaaaaagttcaggagattttggaggcagaaggatggtaggttatttttcagacccttagctcgtggaaccccaaggtagaaatgtccattgactgttgtaggtttggatcaggaacccagaccagtgatgaggaatagagtcattgcttagatatggcggctgtcttcactggccaataagtgagctacagtgaccctgcttctccagcccctggggaagcccaactgtaaatgagaaagacagctccttccagtgggattctttcctaatctaaaggcattcccgattgacaggattagtgaaggacgacagaagaaagtcattactgaataatcccctgcacatttcatagtcaacacagcattcatatgatccttgtaatccaattaggtgatgcaggaagctatatcttaattcctgacttcattgtgacttgcctggtcacaggcaaaccttgtttaataaggtgtcacctaaacactgagtggtgcatacaaaatgggcacagaacggtgatggggttgggggctgaggggaggaggtgactgctgttgagaatatgtcctgtctcaagcagccaataggggacttagaagctccatgtcctcatcagcgaggcttgtgattggaggaggcttgtgattggaggaggcttctgatcggtggaggcttgtgattggagaaggcttctgattggaggcagcttcatctccccttctctccatccattttgctcctccggacctgtgtgtgacaactgtctgtctggtggctggaactcatctgacaataggaacaacaatcatttttacatgattgctacttactgagggcccacttcatacctggcattttacacacctggcccaaaacacccttgggcagagtagattgtatcctcattctaaggatgagaaaactgtgactcagagagattaaggcatttgtctcaggccacacagctagagttacagctgggattcaaatccagatctgtttgatttccttttatttttattttttgagacacagtctcactcttttgcccaggctggagtgcagtggcacaatctcggctcactgcagcctccacctcccaggctcaagcaattctcctgcctcagcctcccaagtagctgggattaccaatgagtgccaccaagcccggctaatttttgtattttttgtacagatctgtttggtttctcaagttagtgtcattcgcctctggcaccatgcccttctgaggtgagattccagaactgacgtgcaaaaaatgtgcaaaaggcctcctgaactgtagcccgggccagtcctggcccgcatgtccatgtgagggctggtttgcctccatcctccttgtgcatgtgaccccagctgtgggcttatgtggaccggatgaatgtgactgtagttacacctagatcacaaacaacatctgagaggaggtgatgcctctgatctctatcagaccacgaggaaactagagagtatggagtctactccaagtgctgggctaggccccagccttatggcttatgctgggatctcaaattccaggccacactgggctacccatgtaaggtcaatgagagaagtaggccaggtgggggcagaggcaaattagaacaagcccattcaccctaacagaggtgatccattctcagcgccaatcattttaccatggggaatgcattccaagttgctcagtcttctggttttccagaagactccagaaatacttattcttatgggcattatcccaattttaaaatggttacaaattcacatttgtaaaaaaataagctgtatgtgagtgtactgggttaaacggcatccctccaaaatcatgtccactcagaatctcagaatgtgatcttatttagaaatacagtctctgcagatataattagttaaattaagatgagttcatactgggttagaatgggctagaaatccaatgactcatcttctcctaaggccatgtgaagacatgcaggaaggtcacgtgctgatagaggcagggactgcactggtgcatctacaagccaagaaacaccaaggaacgccagcagcaactggaacctaggagagagccatggatgcttctccagatcctctagaaccaaccaaccctgctcatgccttgagtgtggacttctgacctccagaactctcattctccaggacgagagaataaattcatgttgttttaagccacgctggttgaagcgatttgttatggtggccgtagggaactaaaacaaagagccaaacccaccagggctgcgagaggaatgtgcccaactgtccttcccatgatcacaggatcatgctcttgatcctgtccctgtccacctcctcgtctgaagcttgactgattcactttctcccttgcattgctgcctgtccactatgctggcctccatccttcctgggctagttccgatgtccccattttaacagcatttcctgatattggccactctaagccttccgtgagcagtagatggtcctgctctgcaccctgaaatctgcctgctgtctgtcagtcaactggagttgttttccaaaggaagctgatgagaaaatccaaaggcttgtcttcatccattctccgtttttcttccagagcttccaacagctggaggccgcctcctctttttggaataccctgctcttttggcagccctggtcctgcccttccaaggtcatctgagcacctttcatcacttcccttggctccgtgatagccttttctttcatcctccggtcccttcaatgtaggcatttcaggcctattctcttctctatgctttaaataagctaactcagtggccctcaactggaagtgatatagccccctagatacatctatcaatatctggagacatttttcattgccacaactgggtgaccctgtactaccggcacctagtaagtcgaggccaaaggcatccaaggggcacaggatagcacctgacaataaagaatgatccagcccaaagtgtcaacaggaccacagttgaaaaaccctgagctaacagaatcccactttgatgctcttgatcatttatctcatgacttgtgcctctcaaggaactctagtcttgaatgtgttcagaaggaaacagttcacgcattgcttcttggagatttccaatgtgcatttgcccttgaaaggctctgacaaggtctgcagccaaataaaaacttgctttgcatttgtttaatccaccatttcctaatgtatttgaatacagaaatcctttgtttaggcaataatcactatcattcttctgaagtaagctgcagtatctaacaatttattgagcatttaccatgttctagagtgtcctaagcacttcacacatcctacagggcctttctccccacaggcagtggggggcagtggggtgcagtggataacagtgttggctctggagtcaggtagctggcttggaatttgcagccacatcagttgagctgtgtgaccttcataaatgccttcatttctctaagcctcaatttccttacctttaagtgagggtacagccatgcatcacaacgatgggatacattccgaggagtggattgttatgagattttgttgctgtgagactatcacagagcgcagttacacaaacctacatggggtggcttagcacatacctaggttatatgctcctaggctacaaacctggacagcatcatactgtactcaatactgtaggcaactttaacacaattttaagtatttgtgcatctaagcatatctaaacatagaaaaggtacagtaacaatatggtataaaagataaaaatggtacacctatataagatacttatcatgaatggagcttgcagaactggtagttgctctgggtgagtcagtaagtcgtgggtgaatatgaaggtgtaggacattactgtacattactgtagactttataaacactgtacacttaggccacactcaatttataaaaaaataaactatgatgttatgactacaatgtaactagtccataggaatttttcagcccctataatagggctgaatagtcaacgatggactgcacatacaatggtggtcccgtaagatattataatcttattataataatctattattatatataatcgataattatatatattataatatataatagataatagattataatcgattatatataatatattatacaatatatactatatataaaatatataatatatattatatatacaccttcatatttgattatatgtaatatattatatataattattattataatctattataataagattataatatctatatctataatagatattatactcttatgggaccaccattgtatatgcagtccaccgttgactgaaacactgaaacatacagtgcatgactgtgtctgtgtgtctgtgtctgtgtgtgtgtgtgtgtgtgtgtgtatatatatatatatatatacatatatatatatatattgcccatgtcaaaaagttctgaatctcaaattagataaaacttgcaaagggctttatggtatgttctcagtaatgttgattattgattgattgatgatgatgaagatggcggtggtgttggcagtgatggtggtggaggtgatggtgatagctgtgatgactgtgaaggcgatgacagtggtggtgatggggataacaggatggtggtgaaagagataataaggtggtggtgatggtgattctgatgggggcggcagtggtagaggtgatagtggtgttggcaatggtggtagtgatgaagatggtgatgatatgaggtggcggccttcgtcatggtgttggtgataatgttggcagcggtggtgatggtggtattgtactctctatttggactgtccttcttgacctggtgaaattatatactcgcctacttatttatctcaaagactacgacgttttcactgattgccccctttgggcataattcttcctcttttgtgtcatatttttttaatgcctccaccatatcactctctgacatacactatcaggacttgtctcctctgctcttcagggggcaccttcccttcacctgccacatacaaagaggggccgtttaataaatgcatgttgacatcaaatagggtggattatggggcaccagaaccttccaacaagcctctccccaactccacaggaaaaatgacaacagaaagcaactcgatgagaattttgcatcccctgccggcttcaaggagacctcaaggcaaactcatgcccagcctcaaaacactcagaaaatgggaggtggcaccagaagacaagtttcattgcaggccaggcactgcccatcctgcttgaaaacagtgagtgatggatgccagtgctgagcaaagcaaaaggagggcctggaaaggaagcagcctggtttcccgctgcaagctagtgatggagacttctgactgcggaagcgagcaagagtcctcagagcagaaatttaagtaggaaggtgtggtgcagggctctgcgcatactaagcggcctgcagacgcgccctgcttcaaagcagagattgcaggctgccagctcctgggcctgcccagcctgcagacagcttttcttgggctcacactctgttgtgctgctttgttttaaattaaaatagttgtcagttaaatcaagagatttcagattaaaactcagatttcttacaaaaagaataataattggaagagtgagcaagcaagcctgggcctgcagttctcaaggcaagggagcctggggctttacactatcgtggagctaagtgagtggcagcttctacctgcctactccaggcattgacatcctgcctggccccttggggtattttgtgacgcttgctataaataccaccagtgtatgaaatgccaacttcatcctggttaagcgcacgtgcttgggggtgcggcagacttggcttcacatcttggctctgattttgcgtagctgggtgatttcaggcaaggttacttgctctccctaagtcctagtttcctcatgggccaagcaaaggatgctaatgacatggctcctccatactgaaggattcaagaagaccggacctaagacacacttatggagtgattctcataactggtacctgtgtcaacagtgaggcgggtactgctgccacgcccattttgcagaggaaaaaccttagactggagggatgaagtgatttgcccaagaatgcctagcttgtgagtgacagagcctggattcaattgcagaaagcctgccttctgcacccaagtcatcaccacttccaactctagatgtttcactcccaagtggcaaaatcatccctccatttcagctcttgcaaatctctgggcctacctttatccccgcttaactgttcagttacatctttgcctttccgatgaggctctgatcaacgctaagtcttgagatactaagttctgcacagctatcacccgtttgcctaatgaataatgaataaatacctaataaataaataatgggtaaataagcacataagaaatcaatcaaatcagctagtgggtagagagtagataaaaacaacaacaaaaaactaacagctcattgactactctttttttttttttggcatttctaaaatctctctgggatcattatacatttcacagcagcactcgaagaaccctccccatgtgggaatccagcaaactgagccatgtgataaaataaataaataaataaataaataaaccatcttctctgcaaccctaaggttcaagtctaccctgagcaaagtgaacccagcattccttggtgcacatccacagtaaatgattacttagcccacagagaaatgtctgtctgcaagactgtgttagttattatcctatcataataaaacagattatgctatagtaatgaatacgaccataatggtctgcggcagtttaatcaatgcattcttcaactgcaactgagcaaaataggtaatggaggatcatttgatctacatttttattaatttggtgtcatctgtctcctggttattttaatcatctctcattatgagaaaatgggaaaacttcctgaaaaaaaaaaaagtagagtcatcttgctctattttattcctcgctttgttttagtgtgaaaagtagcttgttccagttcagtttgggaatggaggttactgatgcctgattaaatgtagttctagatttcagagggaaaagctcccttatctcacacaagtcagacaaagctgttcaagtcatacacaagttgagacgtgttgaaagtggcctggaaccactaacagccaaatcatcatcattatcatcttttttttttttttttggagacctactatgtgctgaatgtgctgagcatggtgctgggtgagctcttctctccagtcctcccacccatcctgcaaaaggacgtaccagtatccccatttacaaatggggttcagagaggtcagctaacctggccaaaggtcacacagctggaaagaggcagtggcagactccaaactcgaagggccccgtctcaatgcctctcagtatttcttgtatgcacgaaagggactgtttgtttctcagtccccaaagacgcgctgagtcacggtagaaattatgcattcaggatactgagtggggaattatgacaaatgctttctttgcagttcctttaaggactgtgtctctcttgatatagctttctggcttaaaaaacgtttgcctagtgcctgcatctgtttacagaaaatctgacgtgttggtaaatttgcaccttgagtgtcctccaagtaacagctttagtccaaacccaggttctaagggcaaccatccctagccttttaatcacatacatcactctctattacttaatcattgttattattattattattgagacagagtcttgctctgtagctcaggctggggtgcagtggcccaactgctgctcattgcaacttctatctcccgggttcaagcaattctcctgcctcagcctcccgagtagctgggactacaggagtgcgccaccacacccagctaatttttgtatttttagtagagacggggtttcaccatattggtcaggctggtctggagatgcctttttcatcaacagatcagcatggccatgtgtggccctgaaggcttaaggttgctagatctttccatttatcttgagggaagctggagatcttgaaatttaaatacaagcatctgatttttaattattagcaactaattcagaaaattcaagcatctagcctgggcctggcatcttgctggctttagtctccatgctaagagtgaaagtgagcatgtgtagggtcttaccacctcttcttcctttacgagtctaaatggctatcaggaatcaaagacacatggactttttgttagagggactaaggagtgtcagtatcacaactgaaatggagagtacaaaaaaaaaaaaaaggctggacttggttgaggggacagtgtggaaaaactgatgtgggactgtgacctcagtgggacatcggactggtgatgcccattgtagtttcccggggctgccctaacaaagtcacacagctggggggcttaaacagcagaaacttactgtctcatagtgccggaggctggaggtccaagatccaggcgttggcagggttcgtttcttctgagggctgagaaggaagaatctattccatgcctttcttctggctcctagggaattgccggtaattcatgttccttggccttgagatgcatcacctgtctttacgtccatgttcccttggcattcttctagtgtgcatgtctatctgtgggtctgaacgtcctctttttatacggacacagtcatgttggattagggcacgctctaatgacctcactttaacttgataatttgcaaagaccctatttccaaataaggccacattcacaagtcctggggcttaggaattcaacctattttgggggatacaatgtaatccataatatctacttagcaattgagtataggattctgaaattctgaagagaggcttgatttaggtataattggcatttaggtggctgttcaacgcagaaagtaacgtaaagaacaatgttcaggtgagtcttgtttggggatttaaaagatgaaagattctaaggatgtgtaatatacgaagtttggtgcttctcaaactttaatgtccataaagtagaaatactggtattcaacttacaatcccaattattacattattattatttgaagggctccagaaggagatctgtgtttttcagtattttttccccattctcattccaggaagaagttccaaaatacattagagaaactattaatttttttttccaaatggacttttctcaccccacaagttggcctcccttggggtgactcctgccctctcctctgccttcccacactcagcaatgtgtcttggttgaagatactggttggaggtttaagatcaatgcccttcgtcctgacaggcagtgaactggtttttcagaacctttctcatgactccaggaagtgcacatgtaattaaactgagtctgtgttgggtttcagattagtgaagtgtgcctgtggcaaaaggtctcttccttcctgagagacgcagcggtgtaattagaatccggagacggattcatcagcatttcttaccagcgtttctacaggatgctccaatattcatctgggcctagttctgcttcctgggagaccatgggatgttgttgctggatgccatctgctggcaaaatgcaggggttcctctcgggtcacttgggtgacactgggggttcagtccattccaagcaagttagctgagagcccaggtaaaagtcagtagcaggctggtaagtgtctgtccttatttccaagtcagtattaaaatggtccaggcgtaaggctggctccaaatccctctgaaggtcattgttcatgcattagcagttcagcaaacatttgtagagcatctggtacatgtcaggccattccaccttcacttagcatcctttcggtgagggcagtggtacctggcacacaggctgggggatttttatcatgagctgaagtcagagcactttttcccctggcctttccattcatccaccccatccctaaaagtcaactgaaaccctggagaaacaagttgcagttattccttgttaaatctgtaatttattcccattaatcctttttgaagacaatggcaaatctgtaaaatgttcaaatacacacaggaaatagcaggccggaattttcagcttttgtcttagaacaggagtcagcagacttcttctgtaaagagttagactgtaaatattaggttggtgcaaaagtaattacggtttttgctattgaaagtgatggccaaaagtgcaactacttttgcaccaacctaatagtttaggcttttggagctgcacagtttctgttgcaaccactcagctctgcccttgaggttggaaagtagccacagatgatgcataaatgaatgggcgtggtagtgtttttacaaaagcagactggcagctgtctttggacccaggacccctgtcttagagaaatcaggttttgtgatgctgtcggaccccaataagggaaaactctaaattccctttcatggcctacaaggtcctgcatgaccagatccctgccctcctctttgtcttcagcatctatgcttcttattgctaattaaacttcagctatcccttccgccttctggctcttagtcatgccaagtgtgtggcaactttaggacttttgcaaagctgttctttcagtttcaacggcaccagtggagctggactccatccttttcagtttctcccacttctatcaacttttccaaataagtcgaggagtttacgtgatctcacaatggggtgagatatctcatgatatgaggtagggcagtcatctgctcattttctagatgcagtaatttctccatttcagtcagtgatagcaacaccaatcaggtcctctaatgaacaatccaggtgtcttcttcgattcctccccagcctcatctctacagccaacagactgccaaattctgccaaatttgcctcctgaattgttttcaaatccaacttttcctctttcttaattgaacctattgtcatttcttgcctagactaccccaaaggcatgcttactggactcttcacttgcagacttggacccctgtaattcatccatccatccatccattcatccatccatccattcatctcattcatccatccactcacccacccagtccatccatccatgatccatccatccatccactcatccagtccattcatccatccatccatccatcatccatccatccactcacccagtccatctatccatccattcatcccattcatccatccactcacccacccagtccatccatccatgatccatccatccatctactcatccagtccattcatccatccatccatccatcatccatccatccacccacccagtccatctattcatccatccatccatccatccatccatccatcccattcatccatccactcatccacccagtccatccatccatccactcacctagtccgtccatccatccatccatccatccatgcatcccattcatccatccactcatccgcccagcccatccatccatgttcctagtccattcatccattcatccatccacccatccatccatccacccaccgagtctgtctgtccttccatccatccacccacccagcctgtccatccatccatccaccaaccacccactcgctcagccagtccattcatccatcctttcatctgtctgtccaattcacttatctttttatccatccattaattgactcatcccatccatgttttcatccactcaacccatctttccatatatccacccatcttctcattcatccctccatttatccatccagtgtatctacttagtaccaggtggtgtaagtagtgaaaaaaaatatttagaacctgccctcctggatcttttagtttaatttggaaaagggatgctaaacaaactacacaaatacatgcatattaataaactggaataaatgctataaaagaaaagttttgcctgagaaagcataactgggtttaaactcagatccaaggaactgcatgaattgctgggagaggcatgagaacaggggtatggacaggaagactagcatgtggggaagccttcagctacagtctgctttctctaggggatgcaggaacagggagaatgggtgagaataaagggagataaggttgaagaaggaggtaggccagactgcagtgagtcctgaaggtctcactgacttgcaatggggaaagtccttggcaagtcttcagcagacgagccacacagttccaagtacatcttaagaagcacactctagatgcagaatgaagattcacttgggagaggcagggagcgggtatgagacgcagatgtgagcaggtaagttaggaatgtattgccacaatctacatgacagggatgttgcagaagagacagagagagaaatggacccagcagtgatattcaggatgtagaattggaaggtcttgctgctggttgaaatgtgagaatgagaactaacctttttcaagctcttcgggaccaagcctgaaccagcctcagtggcctgagctttccagaaggaaataatgctttctttaatgatgaggatagtaataagataattagcactgaacaagcacctactctacaagcaccaggtactttattatgtattacacatcattccatttaggagaacctgttggatagatactatcattagccccattttagagacggggaaaaatgaggcacacagaggtttaggtgatgtgctcaatgttccatagctgttggtagacccaggattcaactctagaaccccaatgattagaagcccatgtccttgaccatctggacaggaccatttccagtattccacatttcacaggatcctattccatgtttttggagccagagaactccggcgtagacacccctctgccaccccggagagaaacctcataggattccagacgcataagtaaagtctggaggctgagctccgctgatctgctgcagtctttattgctctacaaatgcattattaatcagccactggggtcctccccatagagccttttaaattacagttaaattccttgatagcgtttcatgcacctaatggtgcagttcctgtgttcacggcaataaacaaggggagagagggaggcctggataaccaggttaattgctctttgaggtttaggctgagaaagcaatggcaacagcacctctaaattctccaggtccctcactgcaatgctaataaagtcttgaaacaaacagcgctgtcaagccagcatcaggagtagagactacagtttcttcatgcctggcccactgccgtggcttcgctgggcctccaggtcaccttgccagggccctccttcttgggagctttcagtgtgagtgcgtgagtgcatggagatttggtttttaatggccataaaatttcagttttgcaaaacgaaaaagttctggagatgggttgcacaatcaatgcaacaatgaggagagggaggacaagaggcagcattgacgttggaactgatggggcacccctgggaacttgctgcttccttacgagtctcttactcccaggttatgaaacggttgacttttaggggatacagtgtggggaagaggcagttaactagcctatcttctggaactgtcttctccacatgctggagttggaaggtgatagcagccagggagctctccaaagcaggagtattagtctttcacactgttgatagagtcatacccgagactgggtaatttacaaagaaaaagaggtttaatggactcacagttccatgtggcggggaagacctcacaagtatggtagaaggtgaaaggcacgtcctacatggccgcaggcaagagataacttcagctggggaactcctctttataaaaccatcagatctcctgggacttattcaccatcataagaacagcaaaagaaagacccacccccgtgattcaattacctcccactaggtccctcccatgacacatgggaattgtgggagtacaattcaagatgagatttgggtggggacacagccaaaccatatgagcaggggttggcgaattatggtcttgggccaaacccagccatccattttgtaaacaacattttatcagagcacagacatgcctattcatttatgcactatctacacattgagttgagtagttaggacagagaccttctactctgcaaaacctgaactatttattatctagccttttacagaaagtttgtcaatccctatgttaaagtgtaaatcagattgtgctaccgtcttgctcaagacccatccagggctccctacgaccctagagtaaaggtcaaatgacttatctggaacaaatcatctagcctcactctgcaggagaattgtcatctgtgaaatgggagaatgaagaagcctacttcaccaatttagagcaagatttaaatgaggcaatgcatgtttcagaagagctatttttaaaaaatggtaaaacacacaacataaaatttaccgtcttaatcattttaagtgcacaatagtgttaagtatattcatattgttgtgcaaccaatctccacaactttttcattttgcagaattgaaattctacggccattaaaaaacaaatccctgtttctctctccctcaagcccctaggtctcaccatcctactcctgtctctaggaatttaattactctagataccttgtgtaagggggaatcacacagtatctgatctatggtgactggcttatttcacttagcgtgaagtcccccaggtgcatccatgttgcagcatgcgatagggtcttctccctttttaaggctggctagtattccactgtatgtgtagaccacattttgtttatcctttcatctgttcatggacacctgtgttgcctccaccttttgactactctgaataatgctcctataaacaaaggtgtacaaatgtctctttaagactctgccttcaattcttctaggtacacacccagaagagctaacttttattgagcactttctagagacagcctctgctttaataattcacacagatcctctcattctatcctcacaacagccctacaaggtgagaactattaagactatcatcattagggtgaccagataacttattatggtcagtttatgaaaagcctgccaatccctttgttaaagtctaaatgagatcacagcactgtcttgctcaaaacccatgcatggctccctaaaggtcaaacgaattatctgaaacaaatcatccagtctcactctataggagaatcctcatcaggttagagtgagactggagaactcttgagaggaaaaaggggctccattactaactataccaggatgacaggcacagatcgggattgtcctgggcaaaccagataccaatcatcatccccattctatagattaaagatcaagcaacagagcagtgaagtcccttgcacaaggtcccgagtgagggaggggcacagctaaaattcaaacccaagccgaccgactcaagctttcactgctaagcacagttctatgtgcttagcacaaggagcggcaacggtcagcaatcaatgtgaggtgtctcattatggactcttcaggctggggagaggggtcttcaggacgcaaagggtcatcaagggctgagaaagtcagaggggtgagggggaggcttttcacacccaggagtgagactgtggatgccaatgtgtccataccaaatgtgaacttgccccatggagagaagcagatgcccaggtctcccaccatgcttggccacggcaccatggacattttggactggaaaatcattgtggggatgtcctgtgcattgcaggatgctgagcagtatccttcgtgtctacgctttagatgccagtagtaccccctttcccagtcgagacaaccaaatgtctctaggcatgtccagacgtcccgaggggctcagtagcattggttgcaaaccactgaatcagggaaagggcagaactagggggaacaggatgttctcccaggtccgggcttctcaaagtgtagttctggagggcagcagcctctggcagaagtgtgatttctcaggttctgtcctcgacctgggtcagaatccctgggggtggggccttggggggtctgttgccaacacaagcccaagtgtggccggcaagcactgtccttgaccacgcaagaaaattgctgggatctcggaggactaggcacgagagatgttactaacgtgaaacctgaagagggatcccaggcagaatgcaggatggaagatgaggatgttttagaggctgtcaaggtcctgttggtgaccaatacaggatatactgttataaccaatacaggcttttcacagggcagtttgatgctgtctatcacaatttaaaatgggcaagctgtttgacctgccaattctattcttcagatgctctgtagcagccagtctcaactcaggatccccaagagaattaagctcgaatgtcctggggcatccgttgtaggtagcaaattagcttttctctgatgtatccagaatggtactagttatgtacatctttgagagatctgagaaaacagtcacttagtatagtaaaaaactggcaacaacctaaatgtccctcaataggggaatgaccaattacactgtggtgtatccatacccagagttatatggtcagctactataaagaaataacttaggtctctagctccaggcaaggaaacagacctcagacctggacatgtgcaacaacaacaaaaaaatcatctaacttgtgaattctttcatcccacagccagatactattaatatattttttacaagtttcagatttatacatcagtttcatatgatttatgaatctcttgtcacaaaaccacactcttttttttgacatgtgttgagtttagatatctaaagaaaaacaaaaatgtacacacaagtgccactgctcagatgggactgacggatcagggtggattttccccttatctgcaatgtttcagtattttaaaataatgagaatgtatacagccttgacttgaggaattagattttaacaagcatcctttctgcattatttgggcaagttcttaaaaatcgtgaggagaattctcctttccctgccttctcaccatcttttcactttggtcgctgcaaatatcaccggggactggctcttggcagcctcccagttcctctgaaaggtttctcactctatccatgccacacttggaggtgagctattaatttgcgctttgtggctcagctcgattctgatttagggcaacataaaccctcctcaaaattgcgaagaataaattagtttactaatttcgccattaagagtttatcaaagcaagcactatttcaatcgtctcttaatcaatcaccattttccgtgtttatctcctgttcaatttttaccagagggttctatacacatcaatttgtctgatgttcttcctacatatgttttaaattactttatcattgtataaatttcacagccattaaaaggctctaacaccagaatgactgacatggtgttaaaaattgaattcaattccacggggtaataaattgtgacctaaatccaatctctcatgggtgactgaaggatacaatgaaaaattattgctttgtcatttttacactaacacaaatataccacagcaactagaaactggcagagaaatgggaggtaaccgcggctggctatttctcaccccaggcaatgaactgacttcaaacacaagtccttagcgtcttggatgggattggcgcccccgcctccaaaagcaggtgaattatctgactgtgtgggtgggtctcattgcaacagacagattgagcacaaggagcaaatgtaagctgcaaagggcttgcttcagcctgaatgcagctgctcctatagacaccaaagtgcagtggttaagccccttgccacgccactggaaccaaagtctctgagctcagagcctggctctgctactggtgaaatgtgtaattctgggtaagttttctgtgtctcaacttctttgaatacaaagttgttatgaggaataaatgagttaatgtggctaaaccttcttaggatagcccttggcatttaacaatccctacgtagaggttaagtgttattatttaagagcagtttcttgtatagagaccttagctccctgttctttctggctgcagagatggagagtaacaagtatcaatagctagagaaaggtgttgattaacatgcagtgcattttcctttatctctggagaagctagatcagtcatttaacacatctggttccacatttactaagggtaccacagagcagacaagttaaggtgtgggttttgaagttaggcagaagtgggtttgagtctaaggtctgtcacttgcaaatgtgaccctgggcaagctacttaacctctctgaggatcagtttcttcgtctgttcaatggaactagagaacatcccttctccagggctgtgcaggagtcgcgatgagatcacacatgcaaagtgctcgcctccacacctggcattcaggaagtgcctaagaaatgtgggttctcgtgtcctagccccgtgcaggcaggggctggagatccagtggtggagactcaggatatgctatagcagccagtctcacctaagggtccccaacagaattaagggtactcagcccttgtggctcagtgtgggctacagagcactccagcaaccacgctatcctgtgacatgtaccccagcagggaacaggcaaggtggtttgggggcacacagcttgagcacctcacacagacttggagaggtgcagtgtggggagacagcatcacagaaggcttccaggaggaagtggcattgatatgaattcctagccctggactgccaagtaatttgagagaggagaaaaggccagctagttttgttgacttatgcagaaaggagagatagctagtcttttcactctagggcttatttcattcattcattcatttattcattcactcattcactcattcattcattcaagggccatgtctgggctccttccttcttgcactaagtctctgtcttggggaccctgggtggcagacacacaatcagttgtgcccaagggagcaagcctctcatggagcaagaattctatgtgctcttcgaatctccattctctgccttgttctggggcagctactgggcaagaactcatggaacgccaagaaaatcatcacaaaccaccctgccatggaagcgagtctcccatgcccacctgcaggcttccagaaccacaagagctgccaatcgagaggtggcctatggctgacttgtaacaggtgcttggtaaatatttgctggctagaccgatggattaatgaaagtacactcaaatacggtattttattcagcaacctgaggaggcaggggaggcccttgtgcaatctgttttataggaaagacgtgaggctcagagaacacaagtgccttgttcaaggctttcgcagccgataaagtggcagaggggccgcaagtcttttgagtttggttcaaaggcttctcctaatccagggtcaggtcaatgatagtgaaacagcccaggacactgagtctatgacattgctggaggcactgaggatttccttccatggcttggatgtcatgagaaacagcactgtaagaggaggaaagacctcccaaagatgtgtaccctaaatccagggctaagaacttgggggcaggggttgctttcctgatccaagatgacctcttgttcagggctcaaaagtggaagaagcatgattctgtagagagaggatgtgagacctgccccccagtcccagcctgccagacccttacctttggggctgatatagtttggctgtgtccccacccaaatcttaaattgtagctcccataattcccatgtgtcatgggaggaacctggtgggaggtaactgaatcatgggggtgagtttttcccttgctgttctcgtgatagtgaataagtctcatgagatcagatggttttataaagaggaatctccctgcacaagctctttctcttgcctgccacactataagatgtcttttgccttccgccatgattttgaggcctcctcggccacatggaactgtgagtccattaaacctatttttctttataaattacccagtctcaagtaagtctttatcagcagcatgagaacagactaatacaggggggcctaccttcccctcaggtctctggcaatttcagttcagtactgagagatgcctctacctccattctccttgctcaaagcaaagacacagatcctctaaacctagcacttttaggaattacaacttggcctacgagcagattaacctttttgcttataggaagagctcccctgttggtcttgtgagtgttttaaactatcaacacctctgcctacccgagggcctttgcacacgatactcccttgacctggaatgtccccctccagcttttcctctagttaactttcaccacccttcatctcttagctcaactataaaacacaactatgcaactccccagaattgctgttgcaattttacatgtgaattttttttttttttttttttgagatggagtctcgctctgtcatccaggctggagtgcaatggtgcaatctcagctcactgcaacctcctcctcccgggctaaagcaattctcatgccttagcctcctgagtagctggcacccaggtaatttttgtatttttaggagagatggggtttcactatgttggctaggctggtatcaaactcctgacctcaagcgatccacctgcctcccaaagtgctgttattacaggcatgagccaccgcacctggcctacgtgcacattttaatgatcgtttacccctgtgtttccctacccaactttaacaggccacaagctccctgaggacggggattctatctgctttcctcccaaatgaatccatccaaactagttcctggcatagacaggggatgctcgatgactaattgttgaatgagggtatattgaagggagctggtgacaaacagtttcaggtcccaggtggtggatgccatgctcagaataccacctccacagagattctagatgcccatttccattgctttgcttggtgcacacaggcctctgtagagaccccagtgtgaagggaggttgagccactgaggctaaaagcaaccacgttatcttctttcccagtgagggcaagactgaggattatgatgtgccaagcacgagatattcaaagatgagtacgatcaggcccctggcaagtctttccccaccatctaaaccaatgtcaggcacaaagcagcctctcaataaatattaaatgaataaaggaattcagcatatccaaagactaggaactgttccatttgcaagcagcttaattcttagcaagttcttccacaatgagaccaaatctatttctgttccttctctaggcacctatgtagtttttttgtttgtttgtttgtttgtttgtttgtttgttttgagataaagtcttgctgtgccacccaggttggagtgcagtggtgtgatctcagctcactgcaaccttgacctcccgggttgaagcaattctcatgcctcagcctcttgagtagccgggattacagacatgtgccaccacacctggctaacttttgttttgttttgttttagtagagatggtgtttctccatggtggccaggctggtctcaaactcctggcatcaagcaatgcacccaccttggcctcccaaagtgctgagatcacaggcgtgagccaccacacacagcctgtaggcacctatctaaatggttccccacctcacctgtcctctcatcctgctcaacgtcttcaaataaatcatagagtcatatccagacattagattgcagatgtggctattcacttgtcacctctggtctctcctattcaggtagaagctccatgagggtacagccatctagacgcccaattgatttccagaaccaatggacatggtactcaagtggcacaaggtgttctctgctcttgttcacagctctaactccaggtcctagaacaaggattggcaaaccacagcctgtaactatctattttggcatggcccttgagctaagaatgggttgacatcttaagtgggtagaaaacaaatcagaagtagaacagcatttcacaacaagtgaaaattatgtgaaactcacatttcggtgaccataaatgacttgaactgaagcatgcccacaatggtcatttgttgatgtgttgtttatggcagctttcacgctacaatggtaaagttgaatagctgagacagagaccatgcattttacaaagtcccaaatatttatgatctggccctttatagaaactgtgtgtgtgaggccctgtcctggagcacagccttgaatgtggtggctgaccaatgaatgggtcttctgatgttctctggatttgccagtctcttgcctttccccagcaagcccaaggaagacctttgggactagttttgtccaactccaatgaactgttactggatacctcttccttcctgggctcctcagaaggagatgccaaagggcccagttggaactgcaagggccgccttgggaaagcccgtcaaccccacccacttagccaagctgttcctggtcaatgtggcttcatcacatcaccctcattagcgtggtaccttttaacttttcacagctattccctcattttctcatcattggtgatacagcaaaggatctgggagaaagtagtatctctggctgacaaatggggaaactgaggtatttacctgggaccacttgtgacatccccagttctattttccctccactgcggctgtcagctacgctttctagaagccggctactcacgctgtgtagttaccccactgcccccagggcaggagggatgtagaagagactgcccttaagcagctggcagtatcatctgccagtctctctctgcagcgagcggccagccttccccccagaatccccatatccaaaaatccattcctgcaaaggctgatgggtaaagacggtttgttgctgccacaaagaacccccttctgttcatcctcacccctaacacctgtgccagcttccccagtcatgcgcaatttcctttgcccatcacccattggagaactgccgacttcactcagatgcccagaccggggttccccactcaagtccaacccacccagctcccagccaatcatcttccctggaacttctcacatttttcatttctaattcttcacctggatgtctagactgcagacccacaggtcacttacagcatctatgtggtggcttaaccagacccagcaaaggggaagaaatgcaggagcaacgcaaggagccagcagggcctttcttgggacattttaactcaagacacagagaggctggtggccgtgagggccactgcacggagggcgcttcctgacatgcaggtgttcaaaatgtaatgaggcagaaaaagctgtgtcacctggcagctggcacagattgcctcctatgggtcgcaggtgaaacagcctttattggaaaagatgctttgacaatgaaaggggcagagatgcacccttcacccaggatccatgtgttccctgcaaccagggcttctggggaagaggtggtcctggaaggcttcccagaggaagcgcattcagggtgggatctccagaggcaagaggtaacagccaaagtggggtgagtgggagttgtggggacagggagggggctggggaggactggaagctactggggctgtgtctgaagagcagacccagcaagacgtggctgcacaatggctgacaccatcaaagaaacccttttcctctcctctcctttcctcttcttgtcgccccttcatttagacaactcctccattgcgacgattaggttggtgcaaaagtaattgcagaaaaaaaaaagtcattgtggtaatactaacaagccaagcacatccacttaacttccccagtgcactcagcattttatatgcattgtctcatttcagccaaccacgctataaagacagaagatgagtttttgtgtccattttactgtgcagactgagtcactgagcggttagggttatgtcatgagtaacggcagagccaggaattaaaccccattgcccaagctgtccttgactttcaatctgacctggttcattgccctgaaacactaggggttccagttgaatgaccagagaccctagggtgtgtggctcaaaacaaatttctcggaggccatcactgggggtgatgcagcagagtcccttccccacacctcactgcatctccctctgcacggttgccagtggacagccagaggaatccctcttcccctcgtgaaaacagctgtcaccgaaaagggatggagctggggcttccttctaaatcccttttctctggaaagtaaaggagaaaagtcccgagagcaaggaatgtctcacagaaagcaaaccatctcctgggcttctggactcgacattttccctgagtggtggtggggtgaggggacagagagcgtgagggacaggaggagtgggggcgctgtaccaaagtcaacatttaaaatctatttctcttcccctgaatttttcagacttgcagccatgaggaattgtttccttaattatattcaacttccagcacactcttggctgaagtttaggtgatgttgcgtaaagcaaaatgagaaacacagggcatccatctgtgtgtatgcttatatgtatatgaatatttactcatatattaaatttccctccacccctgtctccatctcctcatttagcaaagaaataaaaggaccactgggctgaagctcaaatccctcctaagcagagggaaatctgggtgtcatggtttccagaaagggaacacaatccccgtatggggtgtaattacatcttagctttctgcagaagaatagtttatggcttaaatgctattaattgtaagccgttttgttccatgggaagttgttcattgataactacccaattagggttattttgcaattagtctattcacagtaaatttattgcaaatgggggagtctgtggtgtagcaaattaaagcgtcgctgaggctgggtgtgcaatggcttttaaatgccaatcttattaaccagctcacaggtcctgggagggtgcgctatcctggccagtgcactaaaggcctcaggacaaactccggcaaactcacactgcaaagccatccggagataacctcagcatgaccaggagaagtgcaggaacccctggcctaagatgctgaggttctgatttttttgaacaactgtggagcagtcataaagcaaatagggatgcaatgtacattagcactaccaggtacagttcttagctgtgtactaggcccttggaaaccctctaagctaagtgtgatgatgctcatctcccctttacagatggagaaactgaggcacagagaggtcaagcaacttgcccaaagtcctacagcttgtgcacgggacacctgggattcagatccacgtggtctgcctccaccaccccaggctcttaagcactgacagcatcagcacccctggcttcccaataatgccctgccttcttctcccttgcaacttgagagagagagagagagagagagagagagagagagagagcgagcctgcaggtggaagaacacctctggggcttgacaatgtgagataaagtgacccttctgcctccccaagagggacaggcttatggaaagggatacaggctctgtaacatgagttccagtaccagctctgtcatctgctggccatgtgtttctggccaaggactccccttccttgagcctcgatttcctcactgacaaaaagggttcacaatagactcagcctgtagggctggtgtggggacacagtgtgacaaggcagtgttgcacatattagcacaggtgacccttgaacagcacaggtttgaaccacacgggtccatttataaacagattttcttccctcctgccatccctgagacagcagtaataccaacctctcctccttcttctcctccttttcctcaactcaacataaagacaaggatgaaggcctttatgatgatccacttccacttaatgaacagtaaatatactttctcctccttatgattttcttaacttcttttctctagcttacttacatttatttatttatttacaattttttgttgacagagtcccgccctgttgcctaggctggagtgcaatggcacaatctcagctcactgcagcctccacctcccaagcttaagcgattctcctgcctcagcctcccgagtagctgggattacaggcatgcgccaccacacccagctaagttttgtattttcagtagagacagggttttaccatgtggcccaggctggtcttgaactgatgacctcgggtgatccacctgcctcggcctcccaaagtgctgggattacaggcatgagccaccgtgcctggcctagcttactttattataagaatacagtaaataatggaagtaacatataaaatatgtgtttatcaactgtttatgttaccagtaagctttcagtcaacacaggctattatcagttaaggttttcagggagtcaaaagttgtgctctattttttgactgcaaggaggttggcacccctaaccccagaattcttcaagggtcaactatagacagtgatagcattttgcagggttaagaaaactaaaagcccaagggccaaatccggcccatggcctattctttctttttcctttttttctttttcttttttttttttttttttgagatggagtcttgctctgttgcccaggctggagggcagtggcatgatctcagctcactgcaacctctgccccttgggttcaagcaattctcctgcctcagcctctagagtagctgggattacaggtgcacaccaccatgcccagctaatttttttgtatttttagtagagatgaggtttcgccatgttggccaggctggtctcgaactcctgatctcaaatgatctgcctacctcagtctcccaaagtgctgggattacaggcatgaaccaccacacccagccagcctatttttataagttaggtttaatgggaacatagcgcatttgtgtatgtgtggtctctggctgcttctgccctatgacggatggcagacttgaatagctgtgacaaagactggcccccaaatcctcaaatgcctaagatctggcccttcacagaacaaatgtgctgtctctgatatacagaaggagctcaatatttcgttcatggaatggcattcaactcaggcctccaaaacttctccaccaggcacaggttaacaaaagatgctggaaacgttgcactccacttaattattgctacactctgtgtgccaaatctaatcaagaatatagacaggaaccacctcgaccacttagacaagggtgaaacagcaaggcagaaaggaagcttttctttctaaatctttctatttaaaagtatcgtgtaggccaggcactgtggctcatgcctgtaatcccagcactttgggaggccgaggtgtgtggatcatttgaggtcaggagtttgagaccaacggggccaacatggtgaaaccccacctctactaaaaatacaaaaattatccaggagaggtggcaggcacctgtaatctcagctactcgggaggctaaggcaggagaatcacttgaacctaagagttgaaggttgcagtgatctaagatggcaccactgcactccagcctgggcgacagagcgagactgtctcaaaaaaacaaaacaaaacaaaacagatagaaaacaaaagtattgcacagacacatgcttgctactagaaactaaaataatatagatgcacttgttaaagttgtccctgctgccaccctgtccctgcagatgggggggccataaggaaggtttgctgtctatccatccagccctctttctgtgcaatgagtgtaggtggccacctcctatttgatctaaatcctctattctgtgaccagtggtaaacacagaggcacatatttaaaatgaaaaacacctctaattaactgggggacctggcataagtctcctcccctctatgagcctcatgttcttatctgtccagggaatcgaatgaagagttctcaccaggcgcggtggctcacccctgtaatcccagcactttggggggccgaggcgggtggatcactaggtcaggagttcaagaccagcctggccaagatggtgaaaccctgtctctactaaaaatacaaaaattagctgggtgtgatggcgggcgcctgtaatcccagttactcgggaggctgaggcagggaactgcttgaacctgggaggtggaggttgcagtgagccgagatcatgccactgcactccagcatgatgacagagtgagactccgtctcgaaaaaaaaaacaaaaaaaagagtagcgaatgaagagttctcttaagaggtctttttagtctacttttctggggagccattctcttgctgcacttcctttcttcatcaagagagttgggtgaattgaccatttgccttctcaggaggacaccaggcaaagccttgcatggctcccggatgcaccgatgccggtggaacggaaagcccttcctccccaattctgcagctggcttgattctctgactttatgccttgacattgagcagcacctcagtggatcccttccagctgcatctgttgaccctgacacctccccaatctccatctagctcgactctgacatgcccccaaccccatcggagcccccagagctctctgttgcctccttgctggcctccgtgctcatttaagggtcttttcccttcggagataacaaaagcaggggttggtatttggatttagaagcgacaagggggtactgtgaacctttggccactttgtgagggacagctgggctggccttgcagtgtggcccaatgagaaggagggatggccaggagtaaagagtgaagtaggctcccagggaaggtggagcaaaaagacccctagaatgcaagctgctccctggacagataagaaatctaggccctgagagcagaaaggactctccctgttagctggtagctgagcttgaatgaaatccacacccgtttatttcaaatgcattcctctctgtttgttgctagtggcaccaactcttcgtgggaaggtgccttttggatgctatccgccctctccacagagaaaaccactgagcaaacgaattcacaaacattttgagaatatcttctccaaggaaaaaagtaaaatttaagagtgctcccagaggctggattatcgtaagctatggtggcaggggctagcgggagggaagggggcgtgccctaaacaacagtgaccacgagtcaataaacagcgaccacgtggctgggtgatggtacattggggttctctctactctgagtgggtccgaaatttcctgccataacagtaagcttgtaagatcacttaaaggccatgtgaccttgggagagggattttacatctctcatctgaaaaaaattgggctcatgacatcagcatcagcctcagagagtgttggatgtgataaacaaattgactgcacagagcctggtgcggtgtctagcacacagcgaagcctcagcagccccctgtggctgctgtcattccccttccaagggcactagagaaggtgaaaatcactaccaagaaatacacatcaatggcacgattgcacatgcgctagtgaaactggactccccatcttcagatggcccctccactctgcctgtgaatttctggatcagagcttggatccctccgtgtctcagcaagagagctggtttatcatcaggtcatccgcacataaaagagtgccagtgaagggaaagagggaggggaaaagcaaagagcaaggaaaggtggaaagaaggaaggaaggaaggaagtaaagaatgaaggaaggaaaagaagaaaggagggagggaggagagaaaaattaggaaagaagaggacagaaagcaggaaggaatgtagaagggaagaaagaaaataggaagaaaagaggaaaggagagagaaagaaaattaaaataaggaagaaaggaaataggaaagaaggaagggggaagagaggaaaataaggaagggaatgagaagagggaagaaaaggaaagggagaaacaaaccaggaagaaaatgaggaaggaagggaggaaaaagggagaaagaaaataaaggaatgagaaggaaagaaggagggaaacaggaaacatatgaggaagaaagagaagagaagagggaaagaaacttttgatgaaggaaaacggaaagttacagagcctctgaagttaatgcaaccaattagaaacctctcaaatcataatcaattacaataatattcatatcaattctaatcccaatattctactgaaagagaaacgaaaccatatcaatacagctcccttggctcctgccagcatcacatcagctcccgatttcactataatttcatcctttgccataaaggcaatgggttaaagcacctacaaaaggtaatctgattttgcaaaatttttctgatacaagacttcaacactcagggagtactagaacacatcagatctcgtgtgctcatctggggtttggaaaacagggtggcctttctcagaaggtctgagaaggtgagcagaatggggctgggcaggaggaggaagtggccaggagatccctctctgagccagcggggttggaacttaccctcgagggggcagaaccgagtcaccttctcaggcatcagcagccctaacttgtggcggcagtaagtctccccaatctcctggcggcagtgcttggacttagcacgggacagggcagagatggcctccttgcctgagatgtcacacttagggggctggtcatacttggtctcgggggagctgcccccagttttcctggcatgaggcggtctggacacatccttcccgtggctgctgttggctgcggctctgtccccgggaggcagcacctcaccggggcctttcccagggaatgtatgtccttttcctttctcctgctgttccagcttccttttcaaaagctccttctgtctactcggtggcttcttcgccaactcaggctggtgcttctgcttttgagtcctgggtgcgaagttgctgttgtcgacattctcaaagtctttggggacagagttctcgttgttgctgtctgttcgcactttctctttcggccgatgagaaaagtagccatcctggagaagaggggagagaaacagaagagaaacttgactgagagatcatgctaagcagactggcctttgaagagtgagtcatacggacttggaagccggggccatagtttcacatcctacttttgctactggtttaacctctggtaagatggctctctctggacctcagtttccccatctggaaataggagatgttccaaccagaaaccaaggctttttcaagctctaaagtgccatgactacgattctcaatgcttcttattaaccacaccttttcaagtcagtttctttccttgactgtctttgccactgggtaacaaacattttgttccagcgtcccgtttaaattccagctgaaagtgctgtgatggtttacttaagggctggaaatgatataataaagttataaagggaaaaatattggtaggatattacatacattccattgcctttaggacatgctcatatatctatgcccataagagaaatcagactgagccgttgtaaattctgtgggaaagaaaccagccgcaattttttttttttttttttaagaggaatgcagcccttgtagaataaactttacactaagtcctggagcaaagcaaacttgcgacactcttgtgcttgagtttggctcttcatgtgtgtacatggaacagaagtgatgaagtcatttggggtcaagacaaagatcaggagtcattctggagaccacgcatggcatggatgtttccagaagggctggaccccaaactcagctcctccatgggtaaatgggtcctggttactttgatcagtcgaatgatcaaatgcatcattcaaccaatgccccaaattgtttctgcaacatgttgcttctgcttaaagctcattcccaaggccttaatctgaaagcatatccaatgtcctacaacacggcccctgacctctgaagccacagagaagagtaatggctccatatagctgcccttgttgctatggaaacacaggggcaatgggcggcatccctgctagtcctccttttaaggagggctgaaatatgcctcttaccagttcccaaggaaaaaggtgtcggggcctgaacagcggatctgcaggggtacccaagagcagctgaccctcagcaaggctcccaccccagcaggtcagcaaacaactgcctgtgttttttataaataaagttttattgaaacacagccatacctgtccatttgtgtattgtccatggctgctttcctgatacaatagcagagtgaatagttgcaatagaaactttctggtctgaaaagcttaaaatatttctatccagccctttaagaaaatgtatgcagacccctgctctgctggagtgtgagttaaaaggcctcctcctctgggactgggttagttgcttctgtcctcaccatccatatacgacttagtgatggcctggagaagaaggtgcccctaggactgggcgtggtggctcacacctgtaatcccagtactttgggaggccgaggcaggtgaatcacttgaggtgaggagtttgagaccagcctggtcaacatggcaaaaccccatctctaccaataacacacacacacaaaaaatagctaggggtggtggtgcacacctgtagtctcagctaactcagaaatctgaggcaggagaattgcttgaacctgggaggcggaggttgcagtgagctgagattgcaccaatgtattccagcctggggggagagtgaaactggctctcaaaaaaaaaaaaaaaaaaaaaagatgctcctctagcctctgctccattgctcctagcagtaagcacgaatttctcctatttgttggaggctctgacactaagacaccttgtggccattctgtaagctgagtactgctatgactttcattttgcagatgggaaactaagcacccatgaacaagtgacttgcccagggtcacccagctagttggcggtgaagctggaattcaaaccaggcagatcacagaccccacactctgggctaccagggacatgatccacttccaagaaattgtatgatccttattacacccatcacccaaaacccttaagtactgcaagctgacactgaaccacaagatctggcccctcccacccagctaaatgaatctgctagaggtgtgtgacctccaaattgcaatcttcaggctggctagtggcctattgtgttgcaggaagtcatatagagacagtaagcagcagccacgaagcacgtggagtctgaggctgcaggagctgggaggtaacaaggtaggaagaaggaaaaagaaccaagaaaaaaacagctgaccagtccatattgggtcacagggcggctactggttgtacacaggaactgcttttatatcctgacctataaatgagggccttctgcttctggtctttcttattctccacagatacctacaaaaaaaatccccttcagttggtacctagagtacatctttattcttgtaacctaaacaaaacctgctgatgttcctcttttccctttttttctatccagaggcccttgaagagtcccaagcagcctctcaggcgcattttctgagctcttaccatgagccaggcaccacagtaagttattcacaggtattacttatagggtactgacaattggatgtatttatcttgccattttatagaacgaggagccaacgcttgttgtgatacattcttcactatggatcacgtgctaggtgccatgctaagcccttggatgcagtacctcacttaactcctggaaataatttccaacgtaggcactactgttcgcccaccttacagaaaagggtggaaaataaggttggggatgtcgagtaatttgcacaaattcatgttggggaggcagcgaacttgcatctgcctgattctaaaatctgctattgtatcacgcctcttgtgttttgctgagaagtaaatcaagaagcattcagttcccctgcagtggaataatgggtatcaccatctttgctcatattagcgtctgtcgggatggagctgatggggcaggggtggcattcaataaagctatgaaaaatcatttctgttccattccttctagggatgtgttaggattgtatgtccctatcccttgtatattaggcacagacaggaaacatgctatggccaagagcagtgactggaacccataaggtgtcattccctggataccacaatatccagccacactcctgctggtggaggtcatgcatccctgagtgaggcccatgtggagtagagactctaccaaccctcagtgtgcagaaattgacccctgctgctttgagtcactgagatttgggggatctgtgttactgtagcatggtctaactcatcccgattaatccaggagctaacctgatctcctttcttcctttgagctgagtcaggtacaggagccaatttttttctccctccaacagacagaaacatctattgacgactcccatgctccaagaacataaatttaaattctgtccctaagcccattttctagaagtttctagaaatgtctaaagggcagggagtaagccagaagagctactgccctgatggacatcttcgttttctctcttcagacatatcctaagtgtcattctggggcccttctctttccttgttatcagcaagtttccccgccacacaacagaaaacctccacaaacccccatttcaaaagctcctgttctccatcactttctggctgaactttgccaagcaaaaccagacagaaaacactgcgatcatctccctccaccccccacggccaatgaagctaatctgacaatcagagaatggccaattcctctggctaatgtgtaatatcaggaagaggcaccaccattgattctgatgggactcatgattaatacccgctctctactcaagacaggccaccacaatggcgatgattagcttgtggtggccctgtgaacttctgcctggccccagatgctactcagctgccatgggaacccaaaagatttgagtataagagggaaggaaaatattttgtcttctggaacaaaagggctcacagatactagatcgcttccagaaaagtcagagagaggcgcagtcagcgagaattggaggcctgagaatttctgtccctcagagtcactgtcattttctatagtgactgcggcgttctctctggcttccccccttcaattcatttttttcttttcttttcttttttgagatggagtttcactcttgtcacctaggctggagtgcaacggcgccatcttggctcactgtaacctccgcctcccaggttcaagtgattctcctgcctcagcctcctgagtagctgggattacaggtgtgtgctaccacgcccggctaatttttgtatttttagtagagacgggttttcaccatgttggccaggctggtctcgaactcctgacctcaggtgatccacccacatcaacctccaaaagtgctgggactactatgataataacacttaacatgagatctaccctctgaaccaatttttaagtgtgtattattgttgactatgcagctatagtcaacactatagtactatatgcaacatacagcaaattgttgtatattgttgcatgtactactatattgttggctatagtactgcacagcaggtctctatggcttcttcattgtgcatgcatgattgagatgttatgcctgtccatcagcaactccccatgctcctccccaatcccccaactcctggcaactactacttcactctctggttctaggattcggactattttcgatagctgatagaagcagaataaacacgtgtactatctgtccttctgtgactggtttctttcagttagcataatgtcctcagagttcatccatgttgctgtatgttgcaggattttcttctttttgaagctaacatccattgtgtgtatatgccacattttctttatccagccatccaaggatggacatgacatatcacttcatgttccccctaactcttcatctgactgccaaggggcaaacagattttggcttttctgtcctttctgtggagactcaagatccagaaagccaaacccaggatcccttcccttcacaaaaccaatcttgggaggtctccaggcagacccataaaaaataaccatcatatgcccagcacccaagtggcccatgctctgtgtcctttgaatcttcttgaaaactcaccaaaacagacagtattagtactccttaagaggaggaaactaacatagagagaggttaaataacttgaccgaggctacactgctagtaatgaagtgattcaaactctctgtgtctcagtttcctcatttaaaacattgggatgataacaccttggtatccatggggatgataataatatccatctcaggccgggcacagtggctcacacctgtaatcccagcactttgggaggctgaggcggtcggatcatgaagtccggagatcgagaccatcctggctaacactgtgaaaccccgtctctactaaaaatacaaaaaattagctgggcgtggtggcacgcacctgtagtcccagctactcaggaggctgaggcaggagaatcgcttgaacccaggagatggaggttgcagtgagccaagatcgtgccctgcactgcagcctgggtgacagagtgagactctgtctcaaaacaaacaaacaacacctcacctcttgggtaattcagtgaggaagagtgtatgtaaaactactagaatatgcccaccacacaaagctggaagaagaatgagcagtaaaccagactggggaactctaccaattaacactctctctcccctgacagtctctgcctagaggacagatgggttattatttcgcaattgtgatcaactggcatcatcttctctactcttcatcaatccaactctctcaccttgagttatttatgctaatgcaaccctttgacttactttattttaatgtacttattacaatgattgcacattcaaatgtttgtgtgcaagctccaaaactctaattgctctgctgttgccttacctctaagctgctgctagaatccatttttattctggagaaataattaaatgcaataatgtcctccattcccattcaaccttgggcatgtttagagtcaatttcaatcaggtagaaatatgctaaacataatatggctccgagaagcaggttacctgacccacgctgctgctgcaaagacacgtgggtctgtttccatttttcccaggttctcttggttcaggatgaatcaatacttagtctactgaatcctggccccttgctcccatttctgaggggtgggggtgggttgccgtgatttttaaactatccacctttgctcttattgtttatgtaggagaagacctgggtactagtattgcattagctgatgtccaattttcttatctgtaaaatgatgtgtcccgaatgtgtgttactaaccattctgagttagttattaatcaatatattcaatgaacaaaattctgccacttcagctcattaaaacaattcgatggaccttaagagaccaggaactgaggacaaaatggaagcttcaaagcgcatcccgtctgcagccctatccctctattatcgtctatagcagcacactgagattcagaggtctggactcaggaagaagtgagtttgattcctcccttctccatttgctggggttcttcaagctgggacagaacatttcgcctctctttgcctcagtttcctcatccatcccagagagccgaagatggcacctacttcccagggactgaatcgatcaagcatagaagatagtgcctgacacgtccaaagtgcttaagaaacacgtatgtcttaggttccgttccaagcctgttgcatgtactaactcatttaatctccatgatgagctgataaagaagacgctatattttctacccatttttcagattggaacattaaggttcagggaggttaaatgactaagtccacacacctaggaaacagaggagccaggatttgaacccaggctgtctaggtctggaggtcatgcctttcaataccccactgcctctccgcagctattaggaatagggacagggccaaagggaaaccccagccaggtgcactgctcacacatgagggcgcctggcccacccgctcatcgtgatcagtttacggcttccttttgtgccatgtgcacgcacagccggctgggtagttatttggtgttgaactcagtgtccgaggcttcgttccaatcaccaaggctaccaaggccactgggagggacaaacagggagaggcctgcacctgcttccaaaaggacctccgtgccagggtaggcgaacggtggaagcacagtgtgtgtggctgtaccaattagaacatgcaattacccaggctgccaatgcaaatagacctaacagaggcccctcgtccagctcatctgcatgcacaaaaggtggctggccagcacttagaaacccgtggaccacgctggacgcaggcaggccctgctttaacagaaccctaagtaaaaagccctttgcaatgtagcatcatgttaatgggatgcaaaacagcacagggtgaggcaggaaggagtgagactgatagggctgggttggaatccagtctctgctccttaactctgagacggagggcaagaggtttaacctctcagagcctcatttttctcatctacaaaagaagggggtaagaagacctactttgcaaatgtaaggtggggattaactaatatgtcatgcacatataattctatttaacaaaacaacattgggtgagaggcttgatacatgttaagcactcaagtggcagcaggatgatattttaagctagcgccttgtcacttgatgagcaagtctgagtcttttgtttgtttgtttgagacggagtctcgctctgtcgcccaggctggagtgcagtggtgcgatcacgctcatcgcaagctccgcctcccgggttcacgccattctcctgcctcagcctcccgagtagctgggactacaggcgcccgccaccaagcccggctaatattttttgtattttttagtagagacggggtttcaccatgttagccaggatggtctcaatctcctgacctcatgatccgcccgcctcagcctcccaaagtgctgggattacaggcgtgagccaccacgcccggccaagactgagactttttggaaaggcagagtgttgaggcacagtgggttgaaatctggaccctggcctttgctcactgtgtggcccagggcacagtgcctaactttgtctgcctcagtttccttctctgtaaaatggggacaataatgagtacccaatctaatgaggctgttatgagaattaagagtcaatgaatttaaaacacttaatacctagaacttaataaatattaggtataatttattaaaatagaattaatgattgcaatggtgacttaaagtggttcttaaagtgtggtctgggaactgttgggggtccctgaggccttctcaggggatctttaatgacaaactattttcacgataatataaagacattattttcctttctcgcttactctctcatgagtgtacagtggagttttccagaaactccactgcacgtcatactgcatcagaaatcagaagcaaatgtgagaatctagctatcttctattaagccaggtgttacagagatttgcaaaaaatgtaaaacagtgcctcccttcttcctaaatttgttttcgttggggaaaaatatgcatacttttcataaatatattttatatacacaagtaataggttattatgactgtttttaagtgaattaataaacattttaagaatgccttagtttaaatattactatataggaagtaattgatagcacctacctaagccaaagctctttggtgttcctcaataatgtttgagactatacagcaatcctgagaccaagtttgagaactactgacataatacataagtacaatcagaaatatttactgattattaaaattaaaagtttaggattcttttatgtaggctgttttgctacatgccaagccttttgatttgtattttacttccatacacaatacacacacacagaacagatagaaatcgaagttgagtgataaatactttttttttttttttttttctgagacggagtttcgctctttgttgcccaggctggagtacagtggtgcaatctcggctcaccgcaacctccgcttcccgggttcaagcgattctcttgtctcagcttcccaagtagcacggattacaggtgcccgccaccatgcccgactaatttttgtatttttagtatagacagggtttcaccatgttggccaggctggtctcaaactcctgacttcaggtgatctgcctgccttggcctcccaaagtgctggaattacaggcgtgagccactgcgcccagccgataaatactttcctatagagagaggaacccaggcccctcaagtcctgaatcatcctcagggaggaagaatgacctgctgtcaagagttagtccttgatcaaactctagtcagcctcctctgccccctttttctactgggcctctcagctttacctataaagacttgaatgaaatgctaacgttgtttttctttttctttctttctttcttttttatttatttattttttgagacagggtctcattttgttccccaggctggagtacagtggtatgatcacgactcactgcagcctcaacctcctgacctcaagcgatcctcctgcctcagcctcctgagtagctgggactacacaggctttcaccactatacccagctttttaaattttttgtagagacaggaccttgctatgttgcctaggctggtctcaaactcctaggctcaggcaatccttggcttcctaaagtgctgagattacaagcgtgagctaccacgcctggcctgaaacactaacatagtttctcacagctcaaggcaacatccctgggatgaccccagctcctgcttaaagtgactgctttagaaaactcaaggctgccaaaataatttactgtttgttccagctaacacctctagacagggcatcatctcccagcctctgtaagagagcaggagccacacttcataaacagcagttagcaaacccatttgagtcacacatagaccaaccctcccttcctgcttttggtaattcttcacttccctgagtccactgagctcatctcccttccctccctcccacctctctccttctccctttattattattattattattattattatcattattttgagatggagtctccctctgttgcctaggctggagtgcaatggcatgatctctgctcagtgcaacctccgcctcccgggttcaagcaattctcctgcctcagcctcctgagtagctggaattacaggcgtgtgccacaatgcccagctaattttttttgtatttttagtagagatgggatttcaccatgttggtcaggctggtctcgaactcctgacctcgtgatccacctgccttggcctcccaaagtgctgggattacaggcgtgggccaccgcactctgcttccttctctctttaaaacacccagtcacctctgaacaaatccaagttgagttcagttccatgctggatgcttttcctattgcaacaggcattactgattaaatgtgcccttacccctttcatagggtctggctttgtttatgtttgacgcagcccaaggccacctagcctggacctcaagcctacaaggctaagtccttggggtaaaaaccaaagagcccagcaaagcgtgctcagagcccagcccctgacttaacccactcccctcttcccaaccccaccagggggacatgacagtgacagtcacagcgctcagagcacccaagggactgcaggcaggtggcagggaaagatctgaactggcatctcctggctctttccctatcagcataagagacagctgtgtggtacagagatacacagcagagggcgaaataatggcagaggagaaaaagacgaaaaggaaggaaatgcaagagaaaatggaacgagaagaagaaacaaacatcagctattgtttactatgtgctgattacctaccaggcacggagctaagcccgtggcttggcatcgctattcattcctcaaaattatctcaaaaagtaggtcaggggtcagcaaaacaccctaccacctgcttttgtcaataaagttcttccaggacacagccatgcccattcgtgcacacactgaaggtggtgcttttgtgctaggacggcagagttgtgtagctatgacagagactacatgcccagaaaagccaacatctggctctccgcagaaaaaatgaatgccccttcaaatggggccagtgaggctgagccaggcttgcccaaggtcactcggtgggtaagaggcagggtcagaagtgacgcacaggagtcagactccagagacaacatgaggttgcaaagtcagacccaaggacagagggagagagagcagagccttccagaaatgacaacaaccatgtctgttttggaacaaaatgcctcacacacagaagagcttttctatggagagaggcctcctaactgttttttgtttgtttgtttgtttgtttgtttttaagtgtcccgaaggctggcctcttcttcgttactatttgaacacagtttgcctctaattaattgcagcattccattgcgttattccacagttatggccacaatacccaaagatccagagagaaagggggtgtggtagagacacagagagagagacacacagagaaagacacagagagagagagacacagagagacaaagagagagacacagagagaaagatacagagagaaagatacagagagagacacagagcaagagacacagagagagagacagagagggagacacacacacagataggcacagagagaatgtgaacaacccagtcttgctttaataataaagccttctgcgtacctctcaggcagggtttctcaaggacagcgctgttgacatttggggctggataactctttgttttaggggctatcttgtacattgcagggtatctagcagcatctgtgagctttacccactagaccccagtcatgtgcccttgttacaaccaaaaatgtctccagaccattgtcaaatgtctcctggagtaggagtggggcaaaatcaccttcccacccccgacccctgctgggaaccagggctcaagggcccatactggccgatctcagctgctcaaatcctgttcccattcagaaacagcctttctttccctcattttccaacagaaacagaccctggcatccagccagagcagtcagaataggagagaggctggtatgaagagagctggctggagaaagggccagagttaaccaaggaagggtattccagaggggacagagggaggaggctggctggggtgaccagggagaaatggcagctgcatgaggaaagcgggagaagttagggttcccgctagggaaggatgacacagaagaggagggacacattcatttgggcagtggatagtctttgagttgatggcatgtcttttaatttattttttgttgttggttttttttttttttttttttttttttgagacagagtctcgctttgtcacccaggctggagtgcagtggcacgatcttggctcactgcaacctcggcctccaaggttcaacaaaatcctcccacctcagcctcccaagtagctgggattacagatgcgcatcaccatgcccggctaattttttgtacttttagtagagacgcggtttcaccatgttggccaggctggtctcgaactcctgacctcaagtgatctgcctcccttggcctcccaaagtgctaagattacaggctttgagccactgcgcccggccatgtctcttaatttaagccagaagccacaaccgggaccaatggctccttcaggcacacaggtgtctggttcactctgtagactgttttcatttgtttaacttaatctcggcccacatttcaaaatctagagatttcatctaaaactttggatttctgccccttctggaaacatcagggacctgacaacactgagcttagatttctacgcatgacagttgtcttgaggctaagtagcggtcccatggtctccagaaggggcatctgctctgtccggcccggccagtgtccccttagccctctggcatgtctgcacgcggtgacactgcttcccaccaatgacacaggctcttccgggaggccttctacctcctgagctttgcctcggagatctcagaaccccaaaagatccttgtattccagagtgtttgatggaggtggcattgtccctaatgaggtgttctggaagcgtgtggtggcatttccagttatcacaatgattgggggatgctgttggcaatgagtgggtgggagaacatcagaaacccagcaggacaggggaacactcgtggctggacaatgaagagctgtcctgcatcctgcacatcttctgaacgtccccagatgtcctgtgcgtaaacaactcatttataattatccaggccaggagcctaacttagatttacatatgatacaacattattatgaatggttttaacatagctgaattttctaggaaagtaactactgtttcactcaagaagagattttatatcacttagtttgaccacagtttcagaaaattacatcatcaaaggccacacaagctgtggctgtgagtcaccaacacacacatccattccccgcctgcatttgtaactactgaattctcactgactcaatacgcagtagctgacctcttcatgtatcctccagccccttgcaaccaagtgtggaccactggccagcaacatctgcatcacctgggaacgtgttagatgtgcagaatctcaggccccagcctggaccacaggaatcagggtctgcacattaacagcatccccaagcaattcgtctgcacatcaaaaattgagaagtacgccaggcatggtggctcatgcctgtaatcccagcactttggaagtccgaggtgggcagatcactggagttcaggagttcgaggccagcctggctaacatgatgaaaccctgtctctactgaaaatatcaaaattagccagttgtagtggtgggtgcctgtaatcccacctactcgggaggctgaggcagaaggatcgcttgaacccgggaggcagaggttgcagtgagccaagatcatgccactgcactccagcctaggcgtcacagtgagaatctgtctcaaaaaaaaaaaaaaaaaattgagaagtgctaatgttgttgcacccatcattcattcggtcagtcagtcagtcattcgtttattttggagacagggtctcgatctgtcgtccaggctggagcgcagtagcatgatctcggctcactgcaacctctgcctcccgggttcaagtgattctcctgcctcagcctcccaagtagctggaattacaggtgcacgtcaccatgcctggctaatttttgtatttttagtagagacagcgtttcaccatgttggccaggctggtctggaactcctgacctcaagtgatccacctgcctcagcctcccaaagtgctgggattacaggcatcatcatttaaataataaaacatattatctgtttataaattgctgtcatatatttcttcttcatactattttagcagtctattgatcttttttagagttgtgggtgtttaagtaggatagaataaggctggatttcatttctggttgggtgaaaggaatgttttaaaagatttgtgacattgagcagggctgggtctgctggggttaaaatcacaggtttattcattccacatatgttatttgggtgtccactccctgacagatggggcaggggaaaaggatataggaaggggaactaaagtatgcttcctgctgttggtggaattctgagaaaagagaggaaagtaagtatgaatataagttattttaatataggaccaaaagggagtgtagggatgggtgtgctcaggatttgaatttcatcaagggtgtggagcctcacatggtctggggtccaaggagaatggaggagacttcacagagaaagcagttttccagcctcatcttgagaagaaaggagcaagacagacaaaggaaaaaagggctttccaggcaagggcaaagcatgtgcaaaggtgtggtgagaggaccagcccaactccttttataataacaacgatcccagctaacacttagtgaacatttactctaatgactgagctacacactttatatagattatctttaaaactctcagagcagggccgggcacggtggctcacatctgaaatcccagcactttgggaggctgaggcgtgggaattacttaagcccaagagttcaagagtagcctggccaacatggtgaaaccctgtctctactgaaaatacaaaaattagctgggcgtggtggtgtgcgcctgtaataccagctactcgggaggctgagggaggaaaaacgcttggacctgggaggtgggggttgtagtgagccaatattgcgccactgcactccagcctgagcaacagagggagactccatctcaaaaataaacaaacacatcaacaaacaaaaaaccccagaacaactctattgggtaggtgcaattagtatccacatttcacaggtgaaagtatggaggcatagagaggttaagtaacttgcctcaaatcacacagcatggttataaacttacattgttactcctgtgggctgttaacaactacgcttggctcagtgccccacaggtttctaaagtcccccccaggaggaaacaccacttccaccaaaggccctggaagaaagcaatcactaagtgagctgatctttggcctggggtggggaagggaggagtccagaagtaagagagttatctgaaaagcctgggttcctggtgtaaagtcctcttgcctggctgcctgtgattcattctctacctctgttatttgagattcatttctaggttggtgccacgcccctgactcctgaaagccacaaaccacaatattctatttgtcccctggttttatttccctatacaccttctctgtctctcttgattcaactcccaggaagccctcttgtcctaaccatcatccttcctccccaacattctccgatccaggtcctctgggacggggcacttaaggagacaaatgggtctcctgctgttgaaaaacacccagttttcaaactcatcctttgcctgtgtgggccctatcccccacacacaccctgccacagtgggtaatgaatggttcacttgtaagctcattaccgcagggcctctaaagaaatggaaatgctcacggagccagagacataaataaggagaggcgcctgtaaataaataaatatagatgcacatacacacacacaaacccagttaatttctatcatctgaaagccggaaccatttggggtggggagagagagaaagaaataggctcctaatattgccatccatgtgatttcagaactgagcttccccagaagctgctaataaattatttttactatgcagaggtacaaatgaatatgctgctgtcaccccctaaatctcctttatgagcatgtgtttgccttggcccaacctactggggacaggggcttccgagcaagttttcattggccaagttcctgaaggaggctgccatcttgaaggtctgctctctgtaagctgcgggtgccccactggcacttcctgtttatgcctgaggttggcatggcctgcaggacatccaatgtcgattggaaggccacaggaatcaaagtgacagcagtgcctacactcaagcttttggaaaatgatttctgcagcctggactgagagctgctgttcacaagatggaatgtacccctcttggccatatacttcaataggccctgacattttctaccaagtttcagggtggatatgcaaaaacctcatcactaccaactttcgcgtgcactgtcatcatccagaaggaaactctggtcactccctttggaggcagtgtatccaatgtccagttctccaactgttcagagcaagaagtaggccatggaaatcatggtgatcatgatatgctaccaggacacgatgggcaccgtccgatgaagttgttataaatgtatgccctggagtcactcttgaggatctgaaatccagctctaccacttcccagctgtgtgacctagggaaagtcgtttaccctctctgagccttgctttcctcctacgtaaactatctataatatcaaaacctcgcagggctaaaaagatacgctgacttaaccagtgcaaagacacagttcagaatagttagcagttaataaaaggtagcggttacccacatcatttcatgcgaactcctacaacgacttttcatacattcattcacagatatttactgagtgccaagtacatcttaggtgctggggacatgtctgtgaataagacagacagatgcctgctcctatcgagcttatattttaatagcatgagacagacaaccatcctaccaacaactcaataaacagattctatcacaatgttgggcatctgttatctatttttatctattttatttttataatttcaacttttattttagattctggggatccctgtgcaggttagttgcatgtgtgtattgtgtgatgctgaagtatggagtatgattgaccacttcacccaggtagtgagcgtagtacccaatggttagttttctaacccttgtccccctctagaagttctcggtgtctactgtcaccacctttttgctttttgtttttccagacaaagtctctgtcatccaggctggagtgcagtggcgcgatctccaatcactgcaacctctgcctccggggttcaagagattctcctgcctcagcctcctgagtaggtgggattacagggatgcaccaccacacccagctaatttttgtatatttagtagagacggggtttcaccatgtaggccaggctgttctcgaactcctgacctcctgtgatccacctgcctcggcctcccaaagtgctgggattacaggggtgagcccccgggttcaacctactgttttcatctttatgttcacgtgtactcaatgtttagatcctaattccaagtgagaacatgtggtatgtagtcttctgttcctgcgtcattaatttgcttaggataatggcctccagctgcatccatgttgctgcaaaggacctgattttgttcttttgtattacccactgttcccagatgtgggaactgaggctcacagcggttatctcagcaggtttatgagccagagttgtcccacccaggagagttttggaagtgagaggagcaaccagcaagagaggccggctgcctggctgacaggtaaaagctttgtttcctcctcctcctgcccctcctgccatgattgacagagtgagacgcctccctgcgaacatgaggcatctagttcgggtagacagtttgctactggagaagttccttattcaaggggctgagcagtagtggcaccttttcgtgtatgaccagccagccgtgcccagacttctgaagtctggctggattcagacaccgaactccctttagtcctcaaaggacccatgaaacacccaacacaaggtggttccaagagacccggtggaccgcagttgttcaggccactagatggctctttctgtgaaatttgcagagagcaagccggcagctgcaccttgatactgaagccgggctgcttccctttggacagtcaggacgcatctccgagaagttcttcttcattgccgcaggtgggtgggtcactacctcttcctttaaggggtattcccattaaggcttttcacttcagaggagtttgacaaggcgagactgggatttccacactgtctactaaatcaaagtcattgccatcatgcaactttctgctaactttcccagcttcaagggaaaagtggagcttcatggagctccacttcatcatctgttggcttcacatcatcccatcagagacaagctccatataacagcatctactgtttacccaagattttgcacgattctcttgtttcatcctcccatttatctttggtggagatattatccgatgagatagaaaagtaaactgtggcacagaaagggggttacatgactcaggcaaagtcgcccaggaagcaaggggcaaggctgggatccatcctaggtctgattctgaagcttgtactcttcactttacagcctcatctatgcacagggaagatcctcctgagctctgcaagtgtccaaacttagaatgggcaaccaaggctgactgtgaacatttccttcctggttgggctttaggaagagaagcgaaatttgcctattacctctacacacctcctgagaccaggagaatcctgggtgacaccaggcattcaaggatttcatgatacagtctctccctccctaatgcacctttcagcgttgctactgggacagcatttcctgtgcctttttaaatttaatcctcttcacagccctctcaagaggcagcgcggctctgtgatcaggagcatgaatgctaaagccagactacctgggttctcaacttagccgtgccgttttgaagctgtgtgaccttgggcaggtttcccagctgtagccagctcatggagttgaaatgagaattaagtcaatgttgggaaaacacttaggacaaggcctggaacacaaattgtagctgttactagtatgatcattaatagtagtatgtcctttttcaacatttgagtaaacagaggctcagagaggtgaagacacttccttaaggccacacagatcagggatttaagccatagcaccagacctgggagccaagctaatattccctctccaacacagccccttcaagtcccaggctggaagtgagctgcccttcttagcagtgaaacacctagaaaattggctgacaatttatcgagggcgtcttcaacaagtgtgtcattttggatacactgtgggctaactattggtgcagagagtgggctgaggggtcagcttcttcagcatctggcttcatccatctctgggtcattgatggcttctgtcaagatggccaaagaagaccacgagagtcaggctaggcctcctcctctgcatattaattacagccaaggcaaaatgtggccacagcagcagttaggggacaacaggaccctgcaagtcctcaagcagtcaggcagaggacaccttgggcaccccgccctctgcccagcacaatcttccgtggcactgccgaggacctcagcaagatgcagacctccagggatgtcagcctgtctcctcctctaggtctgtcctctttctgtccctctgtttgtccctctcccctctctcaaccacctctccatcattctgcaatcaacatcctgcccatggtcagggatatctaaaaagctatccaggctgggcgtggtggctcatgcctataatcccagcattttgggaggccaaggcaggcagatgacttgaggtcaggagtttgagaccagcctggacaacatggcgaaacctcgtctctaataaagctacaaaaattatccaggcatggcggcagcacctgtaatcccagatactcgggaggctgaggtgggtgaatcgcttgaacccaggaggaagaggttgcagtgagccaagatcgtgccactgcactccagcctgggtgacagagcaacactctgtgtcaaaataaataaataaataaaaagctattcatcttctgaagaatggaggtggtcagattttgtcttattttctgaaacatacttcaatattttcctaatacaaatatgtgtcagatataaaaaattccaatacaatctagatttatgaaataattcaaaatgtattaaaatgtacagaaaaataatacagtgcccttccatgtaccaattttgttatgttttattcaattatttaaagaaattagactttgcagagacaactgggaagttcctcccagctttcaaccaccatctcccaacccagaggacacttctatccttcacattcatgtatttatatttttagttaatacgtatgtgttcacatacaatgtatagtgttattttgtgtatctgtaagtttgacaaaagggcaccgtgctgtaaatatctcctttgcgtttgcttgtgtcattcaatattagcatttctacccccatctcctctctccttttattttctctcttctcaattcttcttccctcaggtaacatgatgcagaaggaatgacagcatttagttcaccaattctcagccttgccttcccattggactaatctgggagccttcacaaaatgcagatgcccaggtgcccacacgggagatactggtttagtgggttggggctgggcctgggaatcacgatttctaaaagcccccagacagcgaggggtaagcaactggatttggcccctctttcagctttgggtacctgctgtgaatcaaggtcactcctgctcagaggccaggtgaaggaagcatctgataggctggcctgcagcatccaggggagcggctgaaggacaggtactagagctggaggcaggcatcagagccccagtgcccggtcacgcccggggttgtgactctgcttggctccatgcagcatccaggggagtggtggaaggacaggtaccagagctggaggcaggcatcagagctccgttgcctggccacacccggggttgtgacactgcttggctccatggtactctgtggaccctgctcccaccatctgtaaactgagtgtgctgggtgagggcagtacttcctaacacttcctcccttcactggataattttacttggctcacatttaaacataaacatttatgttgttaaaaaaaatgatggtcatgattcctaaaattcaaacaaaaggaaaaaggaacaatgctatggaaccctggctagaccaagttgcctggctaaggctctgaacccagagagtcctttgtctgttgcacagggaaatgtgtaagtgttggcaaggtgttaaggacatcagcaccgtgctgagactttctcattggtttaatccaagagattgcaggagcactggaaaggcaatcatttcctccctggatgattcaaagttatttaatatccacagaatccccgcaaatcatcttgggtgccaccgtgggccacaaacacttcttggaaacacatggacctgggtcagtccctctggtcccttatcacatggatgctgtagggttctatggttctatgggccatacctgagattccattacaggggaatgtcactcccctcccttctctctcagtctcccagaatggggatggatgaagagatccagggtgagctataattcccctcacccagccttaatctggctgtcttcccggccagagctctccaggcaactccactttctacctccaaataatgatggtagtactaagtgcagcactgactgtatgctaggaactgttctaagcaccctgcatggtctagtccttttaaacttcatggcagccctagggggcaaacacagtcagcactcctatttctaaaatggagaaactgaggcacagggaataaaataccttactgaagaccctcaccccagcccccgacttccctaccccctggccagtaagtagccacgaacaactgtactacaatgcccttttgaatggcgggggtgctgacagctgtctatttgctctaaagatgtggctgcttcagggagcaagtgagcagggggagaaagaggaaaagcatttttagaaattatttccgacaggtgaccacatactaaaataacaacatttggtttgccttgctagctggaggcaaaaatcggctcaggtgggagggtgaggctgcaggctaaatgcagacaaggctggcttgccctgagttggcccagttctaggaagggcaccggcatttctgccattaattgatgcactgggaacccccagcttggttttctttaaggagagaaggagctgggtctttcatggtgtaactgtgaaaatgagaacctcccaggggctgcaagacctggttgtatatggagtccagtgagctattttagggacgaagtgtaaaattgtggaaaacagttgtaacacaggatggggtgtgtgtatgaatatttttattgaaagcaagaatatttactgcatacttactatatgccactgttgtaagggattaacctgcattacactatttcatccttgcaaggatccttagatatagctactattgctaaccccatttcacagacaatgaaactgacacacagcaataagtcaccccccccaagtcacacagctagtaagcagctcgttcagagcataaaatccagggctcatcacctccaaacttcacatattgcatgcatagacccacatttccagaacgcctaagaaattcccagtcatccagcacgagtggatggaaatgaaggggcacatcccgtcctcgcttggaaggaagaaggagctagccctggaaaactgacagactggcacgtctggaggcaaagccaagccaacgggagcagatggagcccaggcagcagatgttaatacagtttgctttttccatatgctcttctgtttagctgtaataagtgaattgttctttaatatctgtcaggagctcaaactctgaaggccgggggcagtcacagtcactcaaaaagacacaaagggaagctggccagccgtctcttcacatcccagaggaagggtgcagaatgtgaagaaagatgccaaacacagcaaagtccaggtctttgtgtacacacacacgcatgtgcacacataggcacacacgcacacactcctcgcctgccatgacagtgagattctcacttgacattctagagtctttgaaatcctgcctcagcgtccttcccactcagtaataacaactaagtagaattttcagattttgcctttgaaatgacaacaatgaaagacccaatttgaaatgtataaagggctccaacggctttgctccttgggacttccaacgcaaccacaactcatttccttaatcaagggcagcagggccactgcagaaccctgtcttctgtcttaggatacttcacgtgtcttgggacatccagccccatcactattatcacataggggcggggtgtgatggtgacgtctgtgaacagtatttcttcaacgatatttccatttgacaaccatgaattaggactctcatatagtctcaccaacttcatcttctttctaagtatccagctgtgatactgttatccgcactaccactatacacccgcccagtcagagaataaacacagagggaaggtcccctggtcctcacagttccagctcaacatagagcagaggttgagttctgagctaaacctcagcattatcccttaaaatccacgtgaccttgggcaagttacttctgacatttctaagcctcagtttcttcatctattaaatggaaagaaatagcaccttcctccctcaacagtcctgttgcgaagatcaaatgttaagaaatgcaggttaagtgttcagcacagcaaccggtacttagcaaacacttactgaggagcagctactatttttttattattacttctatttctcattcattcattcatcccactaacactggagcaccttctaggcaacatacattgtgctaggtgctcagtagtgaacaaaacagattcagctcctgccctaatggaacttacattctacagggggagagataatagagaaataatagttgtccaatatgatatgacctggggatgagtactttaaagaaagataagacaggagagaggcagcggatggcatttcagatggggtcaggtaggaactctctgaggaggtagcatttgggtggcccaatggtaagatggagcttctccaaacacataccgggcaaaaggtaccaggcagcaggaatggtaaaagcaaaactctcacagctggggatggtgctgtgcacctgtagtcccagctacttgagaggctgaggcagggggatcacttgagcccaggagttcgaggctgcagtgagctacgactacaccactacactacagcctgagtgacggagtgagactctgtctctaaaaattaaaaatttaaaaagcaaagctctcaaggcagaaatggtctaggaccagtctagcagcaggaagaggaagatggggctgtgatatggagaatagactcatacagcacaggaaagcaagatggggctgaacctgggtacacagagaggagagaagtccgtatctcattctaagtgcactggggagccactgggggcttaagcaggagagcatgccagatctgactgatggatcctggaagagcccactcacccactgctcacagatgcagagagaggaagcaggggcagaaacaaaggtggatgcagccctggccaagtccagactgagatcagaatgcattgcctgggtgctgctccagcctcttctctccggggtgttgctggggagggatgagggaaaatgcacaagtgatgggaatttacttagaagtttctggctgcaagcttgggtgactagaatcacccaggaccccatggtagtgatgatctcacaccagcaaatggctttaaatcagaattcaaatgagtctggtaaaccaggataaagtgtgtaatttaaagcatcccggaagccctgggaacttgcgctagatgcttctcgatctgctctcaggggatctccagcattattctggagagatctggtagcagaattaatgactctggcatttcccacctgatctagggctttgatccttcctgccccatgactgtctcagaaccaaaggttgtgggacaatgggcactgtgcatgtgcccagaccaagaatcagcatttaggcctggctgcaaatttcaccatcatgcccgggggccctgctttctgctgatgtttcagccaggaatgccaggcccttcacccctcaccctggcttgcattcaaatgacccctgcctctgtctccttcaccagactttctcctcctcctctatgcctacagaacacttttaccaactccactacagaactttccacctgaattgcttgttaacatggtatagccccctaaaaatgtgtccttctgaggagcagaacttattcaagtttataacccccaagggtctagccccaaacctggtgtatctctgtgtgtgtgtgtgtgtgtgtgtgtgtgtgtgtgtgtgtgtgtgtccatgtgtgtgtgagtgagtgagagagagagagaaagagagagagacagagagacagagagagactgtgttatgccaatatcaacataaacagcagctaacacaatgggggtctgggcccacgtgcctctctgctaatcactaactttcatgatcttctctgaccctcacaataaacctgtcatagaggatctattattactccaaacatacttagactcaaaaaggctaggacatttgctcaaggtcccggcactagtaattggtaggactggaatttgaaccaggctcatgtaagctcataaatcaagacccttctccaccacacttacttgaaggggtaaacagagactgagcaatatgtgggaggagtgggtgggaggctggggagggaggtatggaataaataatcatggaaggggatggcagatggaaattagagaaattaatacatccaagaatgttctcagggttttggtcaaaccatggactgactcaccaatataaagaccactctccttgtcatcccaaaccattcaccttcaagtatccacggatctgcactgtcactttcttagcccaggtcaacctgtcacccatgtggatccttgatcaacacagcactaaaattgtatgtaaaactggcttagctaatactcattagctagccacacttaggcacattacgtatattagcttcttgaatcctcacaacaatccccatggataggtatcatcatcatcctcatcatcatcatcctcatcatcatccccatccttgttgtaaggttttccagcaagcaatggaagacggggacttgaacccaggtaatctgccaccttcaccacaaagtatagccatcgttgattgtgtccttacactgctctaagcatctccccatgtcttctgctttaagcaaacttatgagatggggagtgttttcattccaattttacagatgaggaaacttacgttcagagttcaaaccctgaattctgttcaggtgtttggggaggtcaaacccaccaaacaccacccagccaaggccacgatcattcactgatcctgcagctttatgagaataataaaaaagattccccttactctgggcaattgcagccctgagtctacagtatgccttgatgaccagagtgtaggtgaattttggctcctacttaactccctcctgtagttatatcctgaacaagcatacgcagaaacactgcagccagctaaaaataggcagaactgagattcaaacccaggcctggcgtggatctagtttttcatcatgtagatgctccatcacccactcagacaccactccccctctttttttttaatccagttcaagaatcaacccaatccaaggctgctcaattaacgctcagtgcagtatcctcaagcaggcaaacgctcagaacgtagacggatccctctagatcatactcctcccacctcctggggctgtggccacttcatcacagtctcagaaaaaactctgggctcacagaaggtaactctgcaccatgagacaatttgtcgaatccttgcagccggtaccgcatgtggccaaatctccccaccccaatcaggcagccacttcacacagtgacctttcctgatctgcactgtcaggctgcaatttagccattctgaggactctgttggaggctgcttcagccaaaagcttgcctctggggagccctcccagggccctggactccgttcagatgtcactttgcattaagggcccactgtgtggggctcctggagaggaagaaagcaaatctctgctgaatgtccctaagacagaagtcaagtgaggagcaggggaggcaaaagaaagacagacagacagacgctgggcatctaaagaaggggtggaggactggtagttccaactggcagcagaaataataataccaggagcttaacatttaccaatcacttaggaaaaaagattaatactaagtgagagtttaagatgtgccaggaactctattaggcataatttttctttttttttttttgagacagggtctggctctgttggccagctggagtgcagcagcataatcgtagctcactgccacctcaagtgaggctcaagtgatctcccacctcagcctcccgagtaaatgagactacaggcatacaccaccagctaatttatttatttatttgtagtagaagatgaggtcctactatgttgcccaggctggtctcaaactcctgagctcaagccatcctcccgcttcggcctcctaaactgctgggattacaggtgtgagccactgggccccacctagacataattcttcaggtgggggccggtaacagttactcctcccttctccaatataaaaatagtgcagtgtccaagcagagaggctacaagataaatcaattgccagcaaaacccttggtgtataacttagctatacagtttcactcatggcaagagtaacggcagctgggatttcttacttacctcctacctgtcagggattgtgtgtgattcttttgttcttcttggggcttgtcttattatgcttattgtagaccgactgtactgatggtcccaagcaatggcctgctgtatgcttgcccttggcaatgtgccctgctgcttctcccaagaggttgagatgacttgtccataccttgaatatgggcaggtcatgcgacctgctttggccaaaagaaggtagcagaggtgaccctaagtttggcttctctgtcttggaaccctgtcactgccatttgctctctactggaggatgagagaccacgtggaggcgagtccaaatgactttcctctcagttgagataatcctagaccagcttagaggcagccaatctccagacatgacagcccaactgagatcaggagaaccaccactgagaccagaagaaccatctagctcacccaaagactcttgaacagtaacaaataaaaatttcttaccgttttaccccactgagtgttgaggtgatttgttaaaacatcccaagaatacaataaatagatttttttaaaaaacctgagcctcagagacataaagtcacttgtctaaggcaacccagctgataagagatggagctgggattctacaccattgtaagttttcatccacgatgatctatacctagggtcaagaaatcattttctgtaaaggactggctaataaatattttaggccttgtaagccatacagtctctgcctcaacctctcaaccctgccattgtagagtgaaaccagtcatagggcgtatgtaaatgaatggtgtgctgtgttccaataaaactttatttctaaaaacaggtggagggccagatttggcctgtgaatggcagtttgctacctcctgctctaggttgcttctctgtatcatcaccatttgtgccagcttttttcccctttctctgtctgtcgcctccctctttccctcctctagaatttccacataaaatcccgcaattgtcttctgccatgtttatgttctaccctgagacatgtgacaagtacctctcaactcaaggggctttgtttccccagcgtaagtgtgtctcaactccctgatttcataaatctatgtcatttccagaaatcagtttgactgatgtgttttcccaatgttaggatgatatctttctggattccctaggtatgggaatttaaaaagttctgattgcattccaaatccaagacccaacatcatcagggtgacagttgagaatgcaaatgactcctattcagaatattaaaaacaaaagcttcagttctgtacctaggaaaatttgactggctccaaaaaaaagtttgcaaaaaaccaaaatgaaaacaaaacaaacgcaaacatgcaaacaaaacaaaaccccaaacccagagtgatgcagaggaaagtctaagagctgtttcatgatcccacacaccccgtctctggggcaacctctctgtaagaagcaagaaaggaagatgacgatgactttctgcagagaacaaaaatttggcttgaagcaaatgaaatcccagtgattttccattttaaggatatctatctcatccaaaaaataaaatgttataatagatttcattttttccatctctttcttgttctttttgcctcttagctgtcctacttagaatatcgaaccgtgttggcaatcaaagtagactctgaacttggctactttctcctcagttaaaagaaaaagaaaaagaggtagacttgagtgtttagcaaagcagctcatccagtttagaggctgaaagccacatcttcaaaatttcaaccaaggaaagttagggttagtgtcaaactttccataatttttaacaactttctaagtaaaactagagatgtctatctggactgactttaattttaaaagtctaaagcaccaaaggcagcggaaggtccatctcatgtttcattacggttaaattctatttccaagaaccaccaacctcagtcccgggacctggcatggatgaagctatttctggaggctgccatgactcttggagccaagaacaaagtggaaggagacgccttacaggcaggggccttcaaccgcatggaagtaccagcagatcctgtgttcagaatcccctactgtactcttagctccccaaactgttgaatcgacccaaggaggtgtcaaagcctaccatggagcatgcacttgtaaatgtctgcaaatgacatgggctttctctgtgttagatgtggaataatcactactaacataattatctccattataaagatgaagagactgaggccaaagtccaaggcccacagctagtgaagggcagagctgagattcacagccagctcatctgacttcagggcctatctgaaacatgacaaaataactgacttggtaaatgatcctattaatttgggtgatcagatagaggtggttacaatgtcctggggtggatcaacaccctggctctgccaccaaatcctgatcctcctcaggccacctgacaattgtcttattttattcatttatttatttttgagacacggtctctgtcacccaggctggagtgcaatggcgcaatcatatctcactgcatcctcagcctcccaggctcaagggatcctcccacttcagccttctgagtagcaaggactgcaggtgcacaccaccacacctggttaacttttttttggcagcgactgggttaatatatgatttagtgggcaccaccacacccagctaactggctatttatgacttttttgtagagaagaggttttgccatgttgccacagggctggtcttgaactcctggacccaagcgatcttcctgctttggcctctcaaactgctgggtgtgggtgtgagccattgtgcctggcctaattgtctcattttaaaagaactttcattcaatgagcagcatatgtaagatgtgggacctgtgaggttggcaggctgaggttatttcccattacacagatgtcgaaactgaggcccaggggtcctgcccactgttacccacctggtagtggcacagtcaagtatgaacaacagatcctgtgtgtccagcccagaaccaatagaggggtttggatttgggtggggtggaacacacccacctcaattttcccagcctctgtctgttctaaggccagaaatcctctgaggcccctgagctgtgttttcctaaagctctgaaggtcaaatacggtgctgaggacctcacacttagaatgtgctgagaaggggtacaggaatgaaagctgctggcttaagtgaaagacatatacaaaaagacctggaaattgtattttatcgcaatagctatttattcctgctgttcggtgttacaaaaatgccatgttccaaaaaggcttaaacaaaagacactgttccactgaccaaaaattaaacagataaaacacagtgtggggacgaggtgtggtaaggaaaggaatgaagagaaaagaatatgataggatggccaggcacggtagctgacacctgtaatcctagcacttagggaggccgagacctgtggatctcttgaccccaggagttcaagaccagcctgggcaacatggcaaaacatcgtctctacaaaaaaacccataaataattagccagctagccgggcatggtggtgcccactaaaccatacacacacacacacacacacacacatatacacatatatatctgtgtgtgtctatatatatgttttttgaaaggttctaaatattatatatattatatatacatgatgggaaattcaatttgccaccagaagcatttaaaataataccataggttttatgagagatatgacctctgtctctgagcttatgagacatgtgagagatatgaattgtctttgagcttcctagcaggcaatgcaaagagggaaacacaattagttatttgaatctgtgtcacagacgagattcctcacttcacaaaaaaaactctcccatctctatttttttcgtgttattatctcttgattgtgttctgtttctcacatatcagttccatctctgtatttgctgagctgatctgtgtatccaaaatgacctgctgtgcagggctcttcacaatagcccctgaaattcagagaggctggctgatgtggatccctgtacagctctggtatagtcaagtgtttatttactgagcgtcacctgaacagactggcgatgaaggagaagtttaaaaccactttggtaggagacgatgccaccagaatagcaatgggaaatgaagcagagaaatccctggcattaaagttgaagtgaatgagaaaagcacatttgtgttgacatcatccctgttggcccacacatggtctttcagaaacactttcctgcacaaagtggggcacatgggaatacagaggccacttcctcacatctctccacactttgcccagtcccacggtcagggatgagacgttcatccacttcatctcagccctgagcactaagggggccacagtgggcagggtcactgtgtgggagcctcaggaaccaggactctggcacatgctgggcagctccatgcaatggaattgtaagctgagttgggctccctgcaggcatgggagcatttcagagccaaaattcccacctgcagctacaagcaaagagagtggaggtcctactttagctaacccgtaaagcgggcacttccaagaagacttttactggaactctgtgctagaagattgggaagttgattctctgtcggctacccccactgctgcctaggggtcctggaaggttgggaggggaggagaggtgactgcaggacagggtatcatggcatccccgagtttacctccaccaaacacacccaaaacctctgtttaacacccaacaactagtatttaattttcattccgctgacctgggagcatctctctaatggaacttccacttagcatagccactgaagttccccagggacagtggtaccaattaaataacgtgacactttggaggtgtaaagctatgtatttactcccaaaccagaggcttgggtagtttttaacataaagattttctccctccttttttttttttttttttttttttttgagactgagtctccttctgtagtgcagcggcacaatcctggctcactgtaacctctgcctcttggcttcaagtgattctcctgtctcagcctcctgagtagctgggattataggcacccatcaccacacccagctaattgtttgtaattttggtagcgacaaggtcttaccacgttgcccaagctggtcttgaactcctgagctcaagtgatcctccctcctcggatgcccaaagtgctggggttacaggcgtgagccaccacgcccggccagaatctctctcttaagagtcaccactagtgcccaatgtttactgttcagaaaggtcattgcccagcagttgcaggcaagaaaccctggacgcatcttggggaaatgcatctaaacaatgcagagcagaagacaggaggggttcatgctctgagtacaggctctggggtcagagaagaatgggtccagatcccagctccatggctgtgcaatcttgaacaagttgcttaaccactctgggcctcactgtcctcacctgtaaaataaggtgttcctgaggcattaggaatgccctgggcgactgtgctgagaatgcaggagcagttacaaggctaagcaactgttcctctgaaggggtcccctgctcagcagagcctcaaaatttggtcctgtctctgcttagggctttctgacaaagcagagtggggaagggaaagggaggtttctggaaaagccagtggccaacttctgggtaccgcggacaggtggcaacacctgtccaaggaccaggcatctctcaggctgtttctaggctgctccacatgagggagaaatgatgggctttgctggccagcccaacaccgtcagagggcatgttactgctcgaaagtacaaaataagcagagtgcgcataactaaacactatttttatcgtctttccgccactctcatgccacaagcaagagctgctgtgtaagggagggtggcagggagatgtttattcagagcatggggtggcctgaataccaatggggccagttgagaggctgtgttgtaagggcttttaggggacagcacccaggagaatcgcagccaccctcaaggctgacctaggagacaaaattgccttcctccccaaactcagccctgcaccctgctgccctgggtgaggaccttatctttcccccacctaggaatctgcaagggtatctttcccttagcatcaggaacaaaacttaccctccagctctgggcaagaaggatctgaaaatgacagttctagggtcgtttggggcaggtacaagcacccttattcctggtgtccagacagtgcatggtgtaggtatacagcaggtactagatgacaattccataaaagaagtaacatccaagggcttgggaggcatctacgaagaatggcaacaaaacccttgccttcacagaactttattctagcacagggacacagaaagatgacagatataacaaatagtgcacagaatagggtagaagagagaagtcagtggttaggatgatgcaatgggtgcatttcttaataaggtggtcaaggcaggctttagactgaaaaggtgaggtataagcaaagactcccagtgggtaagtgagcatgctgcttggctaactgggaaaaagcatttcggggacagggaaactgctgtgcaaaggccctgaggtgacagcaagcctcacgttgctggtggagaccagcaaagaagccagggtggaggaagtaaaagatgaaaaacagaagcttaggtcaggaagaaatgggggatagatcaataaagcattatagagccaggtttttgttttgttttgttttgttttgttttgttttgtttttggagacagattcttgccctgtcacacaggctggagtgcagtggtacgatctcggctcactgcaacctccatctcccaggttcaagcaattctcccacctcagcttccagagtagccgggattacaggtgtgtgctgccatgcccagacaatttttgtatttttagtagagatggggtttcaccaggttggccgggctggtctcgaactcctgacctcaggtgatctgaccactttgacctcccaaagtcctgggattataggcgtgagccaccacacccgacccaagagctatagttcttaactgggtcaacttgacccacaggggacatcttgccatgtctggagacatttttgttgtcacacttggggaaggggaatgctaccagcaactagtgggtagagtccagagatgctgcttaatatcctgtaatgcacaggacgaccctccacaactaagaatgatctggccccacatgtcaacaagttcaaatctagaccactgtaaggcctctggcttttgctctgaatgagctgggattatttggtgaatgaatgaaccccctctgtgcttgcactgatgataacacagactgtaaatctggaggtgtttcatcttcctccaaaccatttctcgcattcatagagtaaggaagaaagaaaagacaccttttttttttttttctccctgcgccaaaagcacacagtggaactcctggttttgaaatgtcctattttatgtgggacctaaaaggatgccaactgtcttctggcctagtgacaacaaaagtgacttcttggaaagctgcggtaacatggaggtggctagggagcagtccaagggaacaaaacaaaacaaaacaaaacaaacctaaaccaaaccatgtttagcaaggcctggggggtgttggggtaccacaggaggcaggctcagcgcgtttatccccatgtaaagattgcagagatggggctggggcttcgcgggtgatttttttagtgctttcacctctaatctccaaatcctagccctgctccttccagaaacctacagccttgcctaaattttgtgtgggtgattaaagcagaggacccgattccctgttcctgcctctctgtttgtgaataatcaaaggctaatcagccaaggccccaggggacaggaaattagacgtgcaagataccagagaggctctgagaataaaactgcgaggtgaatctgacatcaatgccagcaggggtgtctgggctctgatgggcaggagcgcagagcccggggccaactggggacaaatccgatttctccagggctcagctgacctctggcttacaccaaagacagagaaggacaggctgcaagaatctggcttttctccatcagctcagggatcagtcaaatcaaagcattaagaatccagggtgaactctgatattagcgagggcaaaggggatgttctccagactgacacaaaccaccggggttcaaatccccgctcctccacttcctggctgtgttacagtctaaggtctttgagtctcaatttccttatctgtaaaatggaatcaaatacaaataatcaggaatgactttccgagtttcttttggtagaagagtggaaatgaatggagaggaggaagcagaagtactatttagtgactcttgtgagctagacattgtgctcaatgctttagatttatgtttatcgaattctcctaacaactcaatgcagtattggatattccattttcatatgaaaatgctgaggtctcaaaggataaagcacttgcttgagtcagggaaatgaatcccctttccatctgcctccaaatccatgttttattagtaacaccacccaacacagagcactttgaacttctcatgtgtactgccatgctgggtccttataatatatatcagcacgggtgcagtggctcacgcctataatcccagcactccaggaagccaaggcaggaggatcacttgaggccaggagttcgagaacagcctgggcaacaaagtgagacccgcccccaccgacggtgtctctaggaaaagtaaaaaacttagctgggtatcatggagaacgcctgtaatcccagcactctaggaagccaaggcaagatcacttgaggccagcggttcaagaccagcctggagaacaagtgaggaccccatctctaaagaaaatgaaaaaaaaaaaaaaacttagcttggtatgggggcccatgcctatagtcctcactactcaggaggctgaggtgggaggatcacttgagcctaggaggtcgaggctgcagtgagccatgatcatgccactgtgctccaacctaggccacagagtgagaccttgtctctataaaacaaaacaaaaggccgggcgcggtggctcacgcctgtaatcccaccactttgggaggtcgaggcgggcagatcatgaggtcaggagatcgagaccatcctggctaacacggtgaaaccccgcctctactaaaaatacaaaacattagccgggcgtggtggtgtgtgcctgtagtcccagctactcgggaggctgaggcaggagaatggcgtgaacccgggaggtggagcttgcagtgagccgagatcgcgccactgcactccagcctgggcgacgagcgagactccgtctcaaaaaaaaaaaaaaaattattcctgccgagggagccagtgttaagagctatcacggctccattctacagatgaggaaactggagcacatcctgtaaggtctcacttgccaaaatttttgtctccaagagaaaaccagaccctcccttacaaaacaagtcaaaatgagtgtaaaatcggttccgtcaggtgacagccatgaggagacggatggtgtcacatctagtgggggcgagggaatgggctggaggtatagtgtgtccagttgcaggaccaaaaaaccttggcccataactaacgttccctgcacagccaccccatgccacacgcagagcccaggagatctcatctcatcttcacagcacgcctggtggcgagtgccctcactgttcccattttacagatgaggaagatgaggctcaaggagctgacgtcatttataccacactgctattgagtggaggactgcagagttgaaccgggttgcttagcacctttcctgctgctctgaggtcccttaaagtctctgtgaagcgtaaggatgggaggtgggagtcctgaaaaactggtctacctgctgctgtgcgagattgagttgggacagtcagctctcccctctctggcctcagtcttcacccggcagggaaggggctccactgaaggtccttcagctctgacctcctgtgctgctcttcatagaccgtcagctgctgcttcctaatgcaaatgctgtcacttgcctcagggcctttgcacttgctgttctccaggccaggaaaaatatccgtctggatatcctcatggttcactcctcaagcaacttgtcagaggacacgccctatgagagccaccaccccctgccccataggcattccccattcctctaattatgttgctcctcaggccacgtatcactctctgggctattaaagattataattataatctacaatgtctattattaatatgtataatatatatttgcttattgtctgaatatattctatttatatataatattatgtatttgcctattgtctaaatcttccaactagaacgcaagctacttttttatgtcccttcagtatgcacaaaccctggcacatgacaggcattgggtaaatatttgtggaatgaatgcctggatgcattaaatccatttctgggcacctactgcacttaaggcagacgggaaatgcacgtggttaacccaccaccaccagagcatccagctccatgcctttatcaacctggccaccatgtttcatcagcaaatgtgaattgggggaaataacagaatgaagagggggtggcagtaagccccagcaggcttcaggaccagataaaggaggccaaaagattccatttgcacaaaataccatgcagccctctccatcccgttaacccgctcttcctcaaggaacttccagaacaaactattgccaaacaccattgagtttaattactcagatgatattaatagtgcagccagctttaattacagacgacgctgctgcacaggggctaaagacaccctctgaattgctagcgtcccttccacctcgcttctctagctgaggtcgccatatgtgggagttgatttagccttgactctgccatagagacttaccagcaagctttaggagaagagaggctttttgtcccctgcagaattgaatgggggccactcatgctagatttccctaactgccagaacatagctcttatataatgaaggcccaggaaggtctgcagaatgagactggttcgagttcttagagaaaagtttcagaaagacgagggacacaggaaggattctgcttttcccccatcctggtggacatgaaggacccaggataagctatgatgctgctttattaacgaccctttttcaaagcactgaccccggcagcaggaatggaatctggccgcctaggctttctgttaatgagatgagaactgaagttcaaaaataaactgtgggaagcctggtagggaaataccagatgacaagaggataatctggtgaccaaaggcataaaaggtggcgggggtggggagcccacagctaaatcaataaccaggtcgggaggaatttgggggtcaaaagagtggcttagctgttaagaacatggtgaaaactgaccttggatggctccgtaagaatcttagctttgtggagatatttttgtgcctctgacaaaatgctatcttttaagaagtgtgcacagacttcatttctaggcatgtaaccttcacatttaacttgcatttaagcaaaatgatatgcgtgtagggaggattgctatggcgagtttttaattgccaaagactagaaaccacttcagcctcagcagttgtggtatggttaaataaaccatgctatgtgaatgcaaatgcaaaataatgcagctatttctttctttcattctttcttttttttttttttttttttttgagatggagtcttgttctgttacccagtctggagtgcagcggcacgatctcggctcactgaaactgctgcctcctgggttcaagtgattctcctgccttagcctcccgagtggctggggttacaggcacctgccaccatacctggctaattttcatgtttttagtagtgacggggtttcatcaccaccttggccacgctggtctggaactcctgggctcagatgactgcccaccttagcctcccaaagtgctggagttacagatgtgaaccaccgcgcccagcctaatgcagctattaaaaagaatgggggccatgatatatatactgaaccagaacaatcgatgagctagataggtaagcgacaaaagcaagacacaaaataacacgtacagtttgctgctataagttagactgtgctttaagcaccgtctagagcaatccataagacaattcagatcctttctcattagctgtgcaactctgggtatgttactttacctctctgggcctccgttcctttctctctcaactagagctttaataggagttagtttgtatatctaaagcacatattctcaatagggatgactgtcacccccaccaagcaagcaaaatttgggggagtatatgtgtgtgagaaaaaaaaaatcttaggctgggcacagtggctcatacttataatcccagcacttcgggaggctgaggcgggtggattagttgaggttgggagtttgagaccagcctggccaacatggtgaaactctgtctctactacaaatataaaattagccaggcatggtggcgggcgcctataatcccagctactcaggaagctgaggcacgaaaatcccttgaactcaggaggcagtggttgcactgagccaagattgcaccactgtactccagcctgggcaacacaacacaactctgtctcaaaataataataatagtcttagatattgcaatggtcagccgtcccccaaagctcaaccctatctgataaaatcttttcccacagtatttaatttctctcacaagggagaatttatattaaattaaatttttcttcttgggagggtgataatgaaagaaagtaatgcttgagtaatactgagctaaagtactcagaacagcgtgaagcagatggggtgacatttaccttgcaatgtcgctgccaagtttaaatacaataatagatgcaaaggccacagtgcgaaggcgtttcatcagactccaccgcaacaacaggtggcgaatgctaatatcaactctcacttcttagatgaagactcggaggtttacaaaagtggaaagactaggccagaggtcagcatctgagctggaattttcacctggtctctctctcagactaagagcttcctctttatgctccagtggtgcttggagaccacatggtctgtttgttctggtagcttccctaaaatacatgtcagggctcggcacagtggctcatgcctgtaatctcagcactttgggaggccaaggtgggcggatcatttgaggtcagaagttcaagaccaatctggccaacatggtgaaaccccatctctactaaaaatgcaaaaattagccaggcgtggtggcatacaccctagctactcaggaggctaagatgggagaattgcttgaacccaccaggtggatgttgcagtgagccaagattgtgccactgcactccagcctgggtgacagagcaagactcgatctcaaaatactactactactactactactaataataataataataaaaaaatacatgtcgaggtcaacccaggcccaggtaccaggatgtgtccttactctgctgagtatcagcataagatgtcgagtctagaccaggggacaccgtcgtagcagacagccatgaatacctcatcctgtctgctgttagcaagctgcaaagcctgctggtccttcctcttcctcctcttgtgaggccctctggagaaatttccatctgaactgagcactgagaacagatccacctgccatgagcaatggcctgtgtcaattatttggatacagggcagtggaagggacagatttgttttccttgatggcagccagaaagctctttgtcaaatctccagttccccaccatggtgtaggtgttaatacctattccagctccaaggtatgatggtcctatggttgtgtttcctttctttgtctcagttttaatttttgcagtcttattttgtttagtacacccatgcagactgccataaacccttcctgaaagagggatgggtgtaaagagatgaatcaacaaaccacagaacttcaaaaggttccagaaaaaagccaccactggcacaataacgggttactcaatcccccaaggcttttgaggaagactagggaaggaaggggttgaccttgggtctagaatgggtgagggggagagaaaagagaaagcgagagagagctagcaagtgagcacacatgtgaccgtgagcttaatgcaaggggataagctggggtagggttggcagtatgggtagggaaggggagtacatgggaaaggaaaggggaggactggagcttcagtcgtgatggatcttgaaagacagaccactcactgattccttggtttactcattcattcattcaagaactaccatgtgcaaagaattgggctccctgcatgagatacaatgatgtaaaaaataatgacgtggttcctgccctcatggaaatcatatttagttcaggggttggcaaactacagctttaagaccaaatctggcctgcaatcctcttttgcgaaccaaagttttattggtacacaaccactcccgttcatttgcatattatctacagctactgtacagccacgctggcagaactgcttagcggtgacagagcccatgtggccagcaaaggctcagatatttactaatctatctggtcctctacagacagtttgcacacttctgctttagctgctattactgttgctgttgcatattatttgtgagcatataaaaatgtttccaataaacaaagagacatgttgatgcccccgtgagtccccagttttctctgccataaaactggcataagagggccattgtgagggttctaggaaaagctctaagaaataagcccagaacacagacacctacaatccttttacattttcattactaatgatattacaatggctgggagtaagaggaggaatcatttcacgccacatgtctgtctttaaaacacattcagccttttcactctgattctagaaacaggtatgattagttgatcaatgggacctcaatctagacaatccaggcatttgaccacattctcctgatttttcagatgaagattttttttcccatcattttgacatttctggaactgaggcttatcttataaacactgtgtacatatgatttattaatttgtatttgttaagagcaaatgatgtggcagacacacaagatacaggaacaaaatacatatgtgagcaatgcatgtgtgtatatacatgtgcgtgtgtgtgtgtgtgtgtacaggtgcatgcagatatatatgatagttcataagacatcaatttatgctaacgttggaaggtaagaaggcataatttatgcttatgttggaaggtaagaaggcagtaacaccttaaagtctgtcagttggtaataaccatcgtggtgaagggaaaaaaaagtagatcagaggaacagaggagagcagcagtttgcaattttcagagcaatggctgggatagcattcctcccaaaatgacctttgatcaaagaccagaggcaggtgaggagcagatgtgctggaattctggcttcaggcacaggtaagggcaggtgcaaagatgactatctctgtcagtgtgtctttttttccccctccttcctccccaaagctgttgccaacacaatactgtcctccagtcacagaaatgctgtatgtggatggtataagcatgctgcgaaaaaatgctgcagggatttggaccatttggaccgcgcaggggagggtgttaaagtgattgtaacatgttttatttcagctagttcttcaagctcagctcctttgaaatagctgacatgttttcttggccctcaacctgctgtaagcctacgtccaaaagcgtcatatgtcaacaacctggtaaatccacagttaagattttttttttcccacaaaaagtcatgggaaccaaacaggctctgaccaaagttgctggaccagttaaaccactaccagttacttctttgcccacggtgagtaaggctgcttgggaaggtaacctattttctctgaatactctcaaagcattcaagataaatatatctattcatttgtatatcccccaacttggcacagatgaggccttgggtttggatagtaaaatttaacactaccctatgacatttcaatgctaagtttcttggcaaactcaccaagattgcagctgtaggcccagaaagaaagggtgacagcttccagatggcacaggaatgatctggaagtccttgcatgtttatagcaccactcagtgccgcagggtgcccactgtgggccgggggtcatgtttaatttcactaactcctgatgatgagcctgcatcatctccctattgtacaaaggaggcgacagaggttcagcaaagtgctgactgcaaagccatcccagttccccaaatcaggatgcccccttgtcttgaccacccaggacaggatgggagtcattctccaacttagattccagttcatgtgtccaatgtgagcctaagactacagtaactaatctcactactttccctatctagtttccaaaacaaaatgtcctctggataagagcgaacagcagaatggagtttgtgtgtatgtgtgtgcagctttagttttcttaatatttacatataatacagaataccttcttcttcttcttttttttttttttttgagatggagtctcactctgtcacccaggctggagtgcagtggtgcgatctcggctcactgaaacctccgcctcctgggttcaagcgattcttctgcctcagcctcccgagtagctaggattacaggcatgcaccaccacgcccagctaacttttgtatttttagtagagacagggtttcaccatgttggccagggtggtctcgatctcctgacctcatgatccctccaccaccgcctcccaaagtgctgggattatagacgtgaataccttctttcttaacagcattaaacagacgaagtattgctcgactaagcatttgtaactataaggacccggcaaaccccagactctgacttccggagaactttatttccacatgaaaagagcccacacatgttagaaacagtcagtcctgtgttcagattccccttcccctgacaccgccgtggtggggagtccctgtgggggcagtcacttctttcttctaacctgagtctgactcatcctctcactcctctggctaaggacaggaagggacagtaccctctgagaacctgctgagaactgctgtgatgtcccttccctgacccaaacagaaggaggtacccctgaaaaggagacaggattaaaaagccaacccagagagcctctgggtgccaaaggactgccgaagctctttaccctccctctgtatgtggaaatttcagggtaacttaccaagtgctttcttctcttaggagccacagtctgtgtgtactcagattgggagaatgcaaatataagcggttgggagagggaaaaagaacaagagaataggagcgagaacattgggagagagagaacaagagacagataataaatgagaggagaaaaattcgagctacacaccattttcaccctatatactgactttgaagccttaaggtcagccaggcacagtggctcacgcctgtaatcccagcgctctgggaggccgaggcaggcggcgcgcatgtgtatactccaagctactctggaggctgaggcaggagaatggcttgaacccaggaggcaggggctgcagtgagctgagatcacaccactgcactccagcctgggtgacagagtgagactgtcacaaaagatatatatatatatatatattccctctaagtctaagtaagatacaattcctctatacgtgtgtgtttcactttatgcagcagacagacttccaaaaaactggatatgaataaatttcttaaaatctttttatatacatgaaaagtcacaactttaaggtaccccattcatgaggacatgaatcctttggtaagattaaacatccaaattcctagaaatatatccccttgggaattttgagtttcctagtcttgaatgtccttacattcatgaagtcaaaagggtattagaggcatctcttccagccccttcactatgcagaggaagaatctgaggcccagagaggcagggtgacttgcccaaggtcacacagctagagtgagtcagagctgaagcctgaacttgggagtgtagtctctgtagaggtgcacgtactggcggttactcacttgtgctacctgaaataaatggacctgagaatctggtagttatatgagcctgcagttttgtggggtttttgttgttgttgttgttgttgttgagacggagtctcactctactgcccaggctagagtgcaatgacattatctcaggtcactgtaacctccgcctcccgggttcaagcaattctcctgcctcagcctcctgagtagctgggattataggtgtagaccaccacgcccagtaatttttacattttagtagagatgaggtttcaccatgctggtcaggctggtctcgaactcctgacctcgtgatcggcccgcttcggcctcccaaaatgttgggattataggcatgagccaccatgcctggccgagtctgcagttttaatgccttattttctggaagtcaaaactgtattactgaggtgtttctctttttcattacaggagtcatctctattttatttatattttgcagtgaaatgatttaaatcaaatgtgcttgggtgcagaggaaatctgatctgaaagagagtttttatggcagagagagagccagcagatacttatttcctgccttgaagaggccagtaacatcctggtacaaggggattcatcaatacatctttcataagagggcttctctgcacagtgagctggaaaatctttccaatgactctggcccatttgtaactttgcccctgaataaaagaagggattgatcggggcttggaatgcttccatacccagggccttcctgcaccccaggaggcagagtctataaatggaattcaactgggcaattgctcatggagagaaaacccagcaggggtaagcacagcctctaaggagagggcagtgaagggttaaaggtgcaccaccttcctctgctggggtctgcagagggactgatgcctggaagtctctaaaataaagagtctcaaaaatagtcagagagacttgctattgggtattctatggactgcagatccattccccactctccatgatctgcagtgtatgctggtggtgggatataccctcagtgtgtccatcagtcagtcagttggcatttctcaagatctacaatgaaccaaagcagagtgagagagcttgaaggcttcgtaacatggcaaaggggcacggagaattgaaaagtatgtccagttcctgtagacacatcccacaaccccaacctcccaagatggtgccagtaagctttctgttgggtgagagaccaggagacctgagctccaccctggaccctgccacttaagttagcagctcttagggaactgatttctccctttgggcctcaaaagcatgtccaagttgactaagcctgctttaaaagttacttggagaagtgctgagatgattaaataaggacagagtccaacaccaggcacaggacaggccctgaatgaagagattacttcccttctccttagaacctttcctctcctcacccagctccctgtaaggtgaagatacagctctatctacaaagaacggtcacttctctcttcctttctctagggtggtttgggttcaaagacggaaactgtatttgcacccttgcaagctggttcggtccacacttgctttcctacccaaagaccaccacaatccctagcttctttagaacttccttggcatgtgaacttgaacaataccctactcttctccaagacccagtttcagggtaaatgggattagaaaacctaatttagtcagagttgctatgaagattagaaatcaataggtttcccagtacctgacacatggtagatgcccaataaatgaaatttattattttctgcaaggaaaataacatctatctcctctaattgtcatgaggattagaagtaaaatacaaagagcatttagcgcagtgtctggcgcaaaatagcggatactgtatacatcttggttgatggagacaaaagatcaaaagaggaacgtaaacgtgagcaaaagcaaaaaataaaaataaaaaaaaaaggttcaaggaaaaacaaacgtctagcccagagcctagcaatcagagagagctagaaagatatgcgcctaatgcaaagtaggagaggtggaaaggcggctcagagacacgcaagggtctacaacacagtttctcaaccttgacactgctgacattttgggctggatcattccgtcttgggtgagtgctgtcctatgcagtgtaggatgttgagcagcatccttggctctacccactagatgccagtagcatccgtcccccgtagttgtaacaactaaaaaaatgtctctggacattgccaaatgtcccttggggaggcctaattacccccagttgagagttgctagtctaaaatagtgtctgacacaccgtgggtcctcactcagcaaatacttgttgaaagaaggcagggatggaggggagagggatcaacgctgaccaccccatacctgggtagggcaagccctctggcttgcctgggctgcttcagccataatgaacgggtgggagggaggctcttcatggacatgcatcagcttggtttctctgaaacaggagggtgttcctagagtgtactgtctgtgctgtgccttgttaagaggggaaattttccaagaacctatttttccagcgctgcagatttcacgtggatatggccttaaacatccacaaccctgaacctgcatctcattcctctgccttcaaagggattctttggaagcacttcttgtcccaaatggtttaatgcctttattttgcgaatgagccattgcagtcaagaagattaacagggttaagatgtgtgcttgtggttctgggcttagtggtggaaaaatcatgcttcttgcttgtgaacttaaccttttggtggatggtgagaaaggctatgtggggagtgaaataaaatgcataggtcacgggggtaggggccccaggggccaggggtggcagggaagagatgccgtgtgtgctcaaaggcagctcaatttggaggctgggagtgggaacacatcatccctgtaaagatgggatcagattgaaacttctgggacctgatttcaggaatgagctgcaacaaaatgcccgcacacttcttgaacaccttccttttcctccccagctaaaatcctttcctgattcctcagtctcccttgggttcattcacttccctccagccctacttttcccctcttgcttctgggcagtatctttagccattaccaggttttcactcacaccaggacctttgcacatgccacttcctcttgctaaattaatcttcattccatttacacttcttcctttcagcttaaatgtcacttccccggggaaaggctcctgttccctttgggtcaagactcacagtcatacagtctccgtacactgggaatttaatcccatttcacttatcacagtcccactcagtgactggcatctgtccccaccagatagtgatgtggcctgagagcaggaattgcatcttctgctcaataatgtgccctcctcctactcagggtcagtaaacatctgtggaataagtaagtgcataaatggggaaaaggcaggcccggcgcagtggctcatgcctgtaatctcagcactttgggaggccagggcaggtggatcatgaggtcatgagttcaagaccagcctggctaacatggcgaaaccccatctctactaaaaatacaaaaattagccaggcgtggtggcacacacctgaaatcctagctactagggaggctgaggcaggagaatcacttgaacctaggaggcagaggttgcagtgagccgagatcgtgccactgcactctagcctggatgacagagcaagactccatctcaaaaataataataataaaggagagaaggaagagagagctttgttccgagtgtagacaaagagggtttctttcaggggtcatgtcccacagctccattcccagacaccattagaataaaacacagcatggtgtcagagcacggagaaaaaggtgaacttccttctgcctcctttccagctcacacgcatcttgtttccagccccaaacttgatgaagatggggctcccttccttgccttcagcccaggataatcacctgctgcaaatttacccggtgtttaaattgtaacagcaagtcaccaagctcttattgtcacagtagcagaaggggttacatcagagtagaagatgtggaccttggcctcaaggagcccagcagtatcagcactcaggagctggttagaaatgcagactcccaggccccacctcagatgggctgaattagaacctgcatcttaactaggtcctctggttcatgtgagcagcctcgtgggctgctcatgggcttcagtagcctgctcatcagaatcatctggaagatttgttaaactacagattgctagagccctgccttcacccccagtatgtgattccaagagtctgggggtggcaggtgaaggtgcgtttctttccatttcccatgtgatgcagctgctgttggttcaggaccacgcttcgagaacagctgccctactgctcagacccaggcacacagcttagtttccagccagatccatgggactgtgggtgaattccttccttcttcaacaacgttgatgctgatttcatgctgtttgtgcaacttaggcagtaaaaagtttcctttcccccttgtgtgtattagtctgttttcacactgctgataaaggcatgcccgagactgggtaatttattaagaaaaataagtttaatgaactcacagttccaagtggctggggaggccgcacaatcatggtggaaggcaaaaggcacgtcttacatggcagcaggcaaaaggaaaatgagagccaagcaaaaggggtttccccttataaaaccatcagatctcatgagacttattcactacaatgagaacaatataggggaaactgccccgatgattcagttatctcccactgggtccctccatggagggagggaattataggagctacaattcaagatgagatttgggtggggacacaaccaaaccatatcaatgggggtttaagcagaggtctgaggcccagaaaggccttctagaagagtcaaggtgtgagctggaggatgaaaaagagcttgccgacagacaagaggaagaggggcgttctagacacacagcactgcccaagccaaatgaagcaggcgtgaagccaggcacgcccagggggtgactcatctgctgtgcccagagctcaggccaggtaggagggagatccaggggaagggtagggcctggagatcacagaagttctgcctcctgttacctgtaagatccctgctggcatagtactgtgaaggactcaatgaaacatccctgaaatcctcatgatcatcagggctggcattcctgtagcgcttaccatgtatggggtcttgtctcagggccttacccgcattaacatgtttttctttctaacttaaaaaaataataattatagactcacaggaggttgccaagatagcagagttctgcactccctcacccagcttcccccaatggtgacatcttatgtaactgcagtgcaatattaaaaccaggcaattcacatcagtacaatactgttaacgggactgcagattttgtttttgttttcacccattttcaacatactcatgtgtgtatccgtgattctatttactgtttaatcttcacagcaatcctattatcccattttgcagatgggaaaactgaagcacagacagaataaagacagaataaagtgacttgtccaaggagctcgaattcagggaatctagctctaagctactatgcagtgttacttctccggcaagttctggtaactagtgcaaactcgctcatggatcagagatgtttctgagggtactcatatttgaaaaggacttctaggtgtcaaatgtaggttccagacccatcccaaagaaccggatcctcttggaaaagctccccctggccggggctgagcagggaagctgggagagagggcatgtccgcccagggccatggccacagatccccagccttgttggctcctggatagtctctatcccagctcaaaggtgtgcctgtctgcctcatctgctctcaggtttctggtctggtgatgttctcgggactggcctgggctgcctgccaacaccagaactagacaaaaatctgcagttctgagcctcagcccctgcccctggagccctggcaacttcacagaggcctgcttgtgaggccaggaagcaggaagctgggctgctcagccctccgccaacctccaggcccctggctgctggggctggaggagggagagagaaggggacagacaggacatccagtaaagctgtaacaccaccaaaaaaggcctcccacacaagccagccttggcagccagcgacctaccagacaaggcccccctttcctgctgacttttatggagtgttgggctccttggaagggaatgttccctgtgcttagaaatatgtggagatgatctatgcatgtggacagggactgcttagacccatgcacacagcttggtttctagccagatccgtgggactgtgggtgaattctttccttcaacagcattgatgctgctataatgctgtctgtgtaacttaggcaagaaaaggtttcctttcattagaggggaaaacatccaaaccattaaaaaaaaaaaaaagttcataggaatccatgatagcattgggagtggttctgcccagacatggagcgactgtggttaggacccaagaaacagcctcatctgttaacctctccaagactcagtatcctcagctgaaaagtgtggattaggctggaaggatccagcccaaactatgaacctacagggagaatgggaataaggggatataattaaggggcttttatttctattctgtccagagattcaaaatgcagttgcctcagacaggccaggcctcagccatgtgtcaaggtcatcagtgataaatcaatccaccctgggagggtcaggacactggagagggtctgtccagccaaaagaacattagaactcaattgttttaagacactctgcaggccaaaccaaacttgtcgactcactagttactagctttgaattctaaagtcgactcttgtccagaaatcatttcaggagctccaaaatctcaagatcaggagatcctagagaaagattagaagcaacaggccccttgtgtgtggcccttaagttaacacgtcactggctccccagcagggaacctggtgggccctgacttcaggagcctccccaggcccactcatcacccacaaaacagcacccttggggtgctgcagagagggaggaaaagtgcttagtcagcccaccccgctgcacgttgccgagtcagtcatttttttagagccctctagaaaccactagattccaggtcctagaatatgcactacaggcttcccttggagcatgagaagtacctctctgactcccaccaattgctcctccatgaatggcagccatccatccatctgctatccaagagaacgcatactgggtgaaaatgtatgcacaatcagctgagagcaacatgcgaaaccaaattattatctatcccctcccattccaggaaagaaaggcctgtgatgaaagacacagaaacaagaaaaccactacactagtgagagaaaaatcaataatcaaagtgatagaggagaaacttgacaaaccaaagctaacagaataattatgattaacattagatgaggctctgagctccctggtggccaaagcaaaaagggatgctttgtattatataactcatatacaacttgacagctagaagcttagccaaagaaaaagagaaaagttcagtcctggtacgagtttgtcaggcaggtgtgtaggtggcggaggtgataaagtagagaggtgagaggtacccaggtcaaatgcagcctggtgggccaaggtcaggccttggcttatactgaaagaggcatgaggagccacgtggcgggttattcgcagagtcaagacttcatctgactcatgatttaaaagagcagctctgggagctatgctggggatggcccacctggggaaaaggcagaaggagggaggaagatttagagactacagaaaaaagccaggcaagtccttaggagaaaatccattctccttcctaggactgacttacaaagctcagcatgtcctgaacctgcctctccattcaacccaaactcatttctctttccctccctccagctaccctggtctccatctatctcctgccttgtggatgctctttgtcaccttgtgcatttgcacatgttcttccccctactggcatgttcttctccccagcctcatcctttgcatctcagctgaaatgtcagtttcctggagagccatttcccaaacccctatcacaagtagagaattctcgctcccctaactctcaattctagaatcttctgcttctatctcagcactagtcacagcagatcgttattgtaacactgtacctatgtgttggttgttggttttgtcccgtctctctaccaggatgtctattattctaggaagtcaaagataagtctattcccattgcatttcctccagccccatagcataagacttggcacaaagtaggtgcttaataaattatggcgaacaaatggaccccatgaggcagacacagaattagcttcaggttagaaaacggaagctcagagaggctcaggcaacttgcccaaggtcacctggtggtagatctcaagtctgactccaaggctaggccctttgaccctatacccagtttctctgaactcaaattagatgaccttgccctgatcatgcctcggcaagtccctggtaggaggtccttaccactgcattaaaccaagatcttagcgctttgacaaagggccaacgagaacatgaagatgatctgtaaagtccctagaagacgccaggagaagcttaggaaattgcagccgcacctgggtcagatcccaacagagtacaacagcaaaggggcactaggaaatagcccccacctggttggccacactgcctccacctttcaccactcacaacacaaactattctccccgaagcgcacagcttttatctgatcaattttctaggctgtggaaccaaacagtggaatccacaggaaattaagcttattgactcagtctttgaacaccacatggagaagagatatttacacatgtcatcggagccctggggactgtaggttattggcagcatgtatttacagagtttcgcccaacagtggagatggggagaaaaaccaccatgcctccccctccatgcagatttggggaattcagagagatgaaacaagagttaggaccccctgctttttatttatttatttatttatttttgagacagtctctctctgtcgccccggctggagtgctgtggtgtgatctctgctcactgcagcctctacctcctgggctcaagtgattctcccacctcagcctcccaagtagttgggactacaggcacgtgccaccatgcctggatgattttgttaacttttgtagagacaaggtttcactatgttgtccaggttggtcttgaactcctggcctcaagtgatcctcctgcctcagcctcccaaagtgctgggattacaggcgtgagccacagcacccagccaggatccctgctcttgaggctctgttttacttctgcttggctggctcagacagcaggatttggtggtaaagctaattttacacagaccctgttacctgaaagagctcactttgaaaccacaggcagattttttttttttttttgagacggagtctcgctctgtcgcccaggctggagtgcagtggcgcaatctcggctcactgcaggctccgtcacctggggttcacgccattatcctgcctcagcctcccgagtagctgggactacaggcgcccgccacctcgcccggctaattttttgtatttttagtagagacggagtttcaccgtgttagccaggatggtctcgatctcctgacctcgtgatccgcccgcctcggcctcccaaagtgctgggattacaggcgtgagccaccgtgcccggcccccaggcagattttatggagctctcaatgttgcagcaataaactgtgatctgtttccccatctaggtgtttgcctcctgccatttcttcatggttccttgactgtaacttctctttgggtcatttacaattagagaggtgaggcaacctttgacattcttgacggatgccctggaagactggtaaatgaatgcccaaattaaaattaaccacaataaataatggcatcagatgaggcacagtggctcatgcctgtcatctcagcactttgggaggcctaggcgggagggtggtttgagcccaggagttcaagaccagcctgggtaacagagtagtaactcatcactacacaaaatacaaaacttagctgggtatggtagcatgtgtctgtcccaggtacctgggaggctgaggtgggaggatggcttgagcccaggagatcgagtttgcggtgagccataattgcaccactgcactccagcctgggccacggtgggagacgctgtctcaaaaaaaaaaaaaaaaaaaaaaaaaaaaaggcatcaggagctagtatttatggtatgcagtatctctttaccctcacatgttaaatcatgtttccttttgtaatcagaataaaatccaagctccttatcatagcctatgatgtcctacaggatctagctactgcccacctctgtaatgtcccctctcttcctctcactcatcaatatgtttcagccaccacggcgagctcattcctgcctcagggcatttgcacacactattcctctgcctggaatgcttttccctgcatccttgaatatctgtctagtttattcccattgctcaatgctgggatcagttaattacctaccccacaccagtcattacccgtcttgtcaccctgtttaaccattatcacagcaccttttcacttgtttgaagcgttcttatgtatttccttatgtgtttatcatctgtgtcttcttgctaaggtcggtgaagctgagaccttggattttcagatttccagattcccagtatatctaatgcctgacgtgataccaacacatagcggatgctgaataaatactcaaggaagaaatgaaagagagaatgggaactggaccctgggtttacttgatctcactccaaagccggggctcttaaccactgagctacacagcctcatcacaggacactctgctgaatcagcagctcctgttcaaacagctagacttccaaagtcaacaccagcacatggcttttcgggggaggagtacatttcatcacaaggccaagattgtgttttgttttgtaaatcacttcctaagtattaccaaggctcccacaccaatgaatccttcctcctttcctcctgcagggtagaaggtcctggcttggttctccaaccagctaaaggcctgtttcccgcatgcaaagatgatgtttgtgctttagcaaaatgcaacgtcatgcaatcctggggtcagttatgcagatccgaagcactactggaattcagaacctggttccatgaatttgttaactgagtctacagatgtatataatgaacttccagacactcaagacgatgcagagaaaaaccagaaaactatagtgggaaaagcaaggattatgatgacaagaactccatgtggttccatcctgggatctgcttactctttttttttttttttcttcagatgagtctaactctcgcccaggctgaagggcagtggcacgatctcagctccctgcaacctctgcttcctgggttcaagcgattctcctgcctcatcctctcgagtagctgggattacaggcatgtgccaccatgccggggtaatttttgtatttttagtagagacagggtttcaccatgttggcctggctggtctcaaactcctaacctcaggtgatctgcccgcctacgccttccaaagtgctgggattacaagcatgagccaccatgcctggcctctccttattctcttgctgggtgaacttgaatgagctacctccactttttaagcctcagttttcaagtacgtaaaatggaggcaatgactgtgcatttattgggaagggcttactttcaaggccacagaaagaaatacatgaaaaaaaatctatcagaatgcctggaacttataataaatgatcttgaaacatttgttcaatgcctaccatgttcaaggtgcagcacagtaccttgcctgagagattctaagagcatgacaggaagggtcctgtctttattctatttcccaaattccgcatcagaacacataggctgatcaaagaatgggtcagagagtgtgaaacagagaccattcaggaattttttttttttttggaaactaaatctgtgtcacccaggctggagtgcagtggcgcaatcgtggctcactgcaacctctgcctcccggattcaagcgattctcatgactcagcctcccaaataggtaggattacaggcaagcaccaccacgcccagctagtttttgtatttttagtacagtcagtttcaccatattggccaggctggtcttgaactcctggcctcaagtgatcctcccatgtcggcctcccaaagtgctgggattacaggcgtgagcccccacaccccgcccaggaacatctcatatcaagataccaagcctgaatttgaattccagctctgacatttgaggcacccctcaccccatttctgggccttagtttccccactgaatggaaataatggcctatgtcatctggccccttcgtacctctccaccttctcccatccccttttctcagctcccctccccactggaattcctggagtcttcaaccatgctaagcgccaggcagttcgcatgctcttttctttctgcccagaacagcctttcttctggctcttctgggactagctcctcattcaaccctcagtcttccctggccatcctacataacatagcccactccatttgatctgacagcagctccttcttcacttctttattaccactaatcaacatttgtagtgatatatgtattgtttgtttcctgtctctttcttccccagactacggaggttgtaaacattcagaaaaaggaaccgtgcctgttttgattagcagtgtatttccaaaaacctagcacagtgcctgaagcacagcaggtgctcaataaaggcttgatgaggggatgggtgaaagtttggcattccctccaatctatcgcatcaaggccttcatctaacccactatgaagaccctcaaacacaccattcccaatgcttacatccaaaacctctttctgccccacctcctgaggaaatggggcatgagttgtgagtttccttagctgtgtgaccttggaaaagtttcttttttttttttttttgagactgagtcttgctctgtcaccaggctgcagtgcagtggtgcgatatcggctcactgcaacctccgcctcctgggttcaagcgattctcctgcctcagcctcccaagtagctaggactacaggcccccaccaccacacccagctaatttttttgtatttttagtatagacgcggtttcaccatgttggccaggatggtcttgaactcctgacctcgtgatctgcccaccttgccctcccaaagtgctgggattacaggtatgagccaccgcatctggccgaccttggaaaagtttcttaaccactctgtgcctaggttttcttaccacggaaatgaggttaatgataatagttcctgactcatagaattgtttttggcactgcatgagttaacatacataaaggacttcggtaaaatatacgtaaggcacttagcactttttatgccttgtatgtgaataaatgtcatctagggtaggtggagccctgtccctaccattccatgcaggtttccctgagtacctttttttcacacaggtaggttagctcctcatctacaaagtgctcctcaactctgaggcccattggaatcacctagagagctacgaattaccctggagttgtatccatacccacaacatcagactccagtggggcaggctgtacatctgctttttactctccccgggtgattccaacatgaatctgaaattgaaaaccactataaacgcctcatgctcaaaggatctcacaactgcccactgcacactgccctccccaacaaactttactatttttactgtaatagcccacattggacagttcccaaagtactaactagcctttttttttttttttttttttttttttttttttttgaggcagtctcactttgtcatccaggctggagtgcagtggcatgacctcagttcactgcagccttgacttctttggttcaagcaattctcctgcctcagcctctcaagtagctgggattacaggaatgcaccaccacgctctgctactttttgtatttttagtagagatggggtttcaccatgttgggcaggctggtctcgaactcctgacctcaagtgatctccccgtgtcagactcccgaagtgctgggattacaggcatgagccaccacacccagctatctgttctgttctccttagagcagtggttctcaatcgggggcaattttgccctgtaggggacatatggcaatgtccatagacattgtggttccagggatggggtgctattggaatctactcggtagagaccagagatgcttctaaacatcctacagtacctgggaacccctgcacacaaaaaatgacttatccagccccaaatggtatggtggcaaggttggcaaaccctgctgcggagctatcttttctgtgaacttggggaggacagcgcagccttgctaacaatgggaaggaaagaagaagtagtgaagggaacttatcatcactgagtttcaacaccaaacacataccaagcagatgtttcacgaataatgacaatagccactactttctgagcaccaaacaatggcttacaacagaacggaacccctgagttatcttacttaactcacatggcaactctgagttctttgactgtgttttcgcttcatgcataagacagcggggacagcaaggttaggtaactaggccaaagtcacaagacttgtacatgacagatttagattttagcctattctgttaaacttcaaagagaaggctaccccaacagattaatgatgccagctcacacctcctaagcctcacagtacctaccaggcagtgctctgaagacccgacaagtagaaacttaattcattcccatgaactagataatataatcatcatcgtcatcatcatcatctccattttacatcctgggacgctgagacagagtgctgcagtgtcctttgaagaatttcatgcagctgagatagggttttaacaaggggtttagatccagaatctggctcactcccaccatactctcctgcctctaatagagcaatgagcagaaaggatcgaattccagcctgcctcaggacctctgcacatgctgctcctgatgatgtatatgtcttcactctggcctctttgccctgctaactcttttttactcattggatctcagtttatacttccattgtctaggacaccctcctagccctgccaactcactgaccagatgagttatctccgttaaactctctcctagctccccttcatagcatttcacactttaaaagaacccaacacttgtgcaagtgtttggtgaccatcagtctcctcctatagactatagactccatgcagacaggaactgtctctgccttgtgcagtgctgtatctccaggcccctggcatgatgtttggcacaaagggggtgcttgatgaaagcttgtggctgaatgcatgaaacagagaacctaaaggcaaaacagcagctggtgccaatccggtccatttcctcatccccagagagggacagggccatctggcaggtcctagccaaatacctccatggcaggtcagggctgcagagctctccaggcaagctggccatggaggccataaaccaactcctcaaagccatctctgcttcatggtggctggtctttatcattttccaatcaacactggttgagttctaattgattttctatgatatccctctccagaagggagaaaggctctgtttactggggcagtacgtagaggacaggcctattcttcctgctgtatttaatgctgctgctaatcacggagattagactaaaacaattacaacagctaattaaagaacaatgcggtttttggcatcttcgcgcagacggcaccattgggaattcctaactcgggcaaagcagggataattaaaaccccggctccactctccccactccagcagctggatcacgctgattaaactgcaaataaaacacatgaaaccaacactttgtagtctatccaatttcacttaaaagggcttttaactgattcataaacagagaagcggtaaacagcaaattatttaactaaagccagttatttcgtcatcacggttcactttattcccagctccggacttgtacatgtagcccaggggacattaggttgatggggcctgaggaatcactccagagcttactgccacttgctcctgttcactggcaacaggacatcaccagtgtgtagctgctttctctgggttttttctccttttgaaaaaaaaagatcaggtagtgcccaagtccccagatgaatatgcccaggtctgatcagactctgctctcgattctaggtcaagagcagatggcagagacacagaaagttccgaagcgcagataatactaaaagcatcatatgtagctttaaaacatttaacttattcagagctggccaacttcagatctaaaatgcaacccgtatctactaaagtatgaaacagacttgttctcaagctatgggaagacatgtcacaacagctgggtagaaagctcatttgttttagacaggcacactctgagaccccagctcaggtcccatgcacacatgcttcccaactcatcttaacaagcatggtcatggggattgctaattctctctccaccttgccaatccagagacaacaagggaaaaaagtgagaaataaaaagaaaaaggtcaagggaaaaagaaaaggacagaagagaaaagggagaaaatggtaacgctagagacaggctcactgggagcagcaagaagggacagaaaaagaaaaaaataccacaagaaagcagacacagggattttcagagcccagcatgacacatgcggtgaggacctaggagccagcgcctgtccctttgcagtggccaggtatgatggtcacgttccacagcagtgcttctcaaaccagctgtggagaaaggcctttgtatgcccagtctactgcagggtgctaattttgtaaaataaaacaaaaaaagaagcattaaaaataaaagattgacttgcttaggtgccatgccatgtccggttactataaaagctgctgaaagcttgtccttcgtttctgagcgcgtcttcgtgcacacagtgagaaaccctggggatggcactggtccatggaccgacaacgctctgagtagtcctttttgaaaagatcccccacggtcattgggaataaacataatcagattcataggattctatttaatgtgcaccacatgtttttagtgaacaaatgcaggctttcagacacacataaatgtagaaaacaaagaccggaaagacatgcatcaaagattttatttcggaataatgatttcaccgatctttcttctctttttttcaagctttgttataaaatactcatgaaagttatttttaaatgaatattccatttatgaaggcaaagaaagacgatgctttatcataacacgagttatagctatttatatataattatggatgttatttatttataagtatctattatgtggttcaaaaaacgctatgtaactgcatgtagcctcatggaaaaaaaaatatgcagccaatatatatgatgtttgaaaagaatactctgggcgggggtgccgggcacggtggctcatgcctgtaatcccagcactttgggaggctgaggtgggcagattgcctgaggtcaggagttcgagaccagtctggccaacatggtgaaaccctgtctctactaaaaatacaaaaaaattagctgggcataggtggcgtgcgcctgtaatcccagctacttgggaggctaagacaggggaattgcttgaaccagggtggtggaggttgcagtgagccaagatggtgccactgcactctagcctgggcgacagagcgagactctgtctcaaaacaaaaagaatactctgattttagaagatgcttttgcaatttgatcatcaaattgccaatattgacccttttctgaccaatgaaaacagcaatttcatataatttaatctaatattaaatgggatctaaaaggttcccataaatagaggttgaaatcaattatgtagaaaatacacatacacggaaaagaagactggaaaaaaacatacaaaaagctggcatggcgattttattttttccttcttggtcattttccaaatttccaaccgtgggaatatattgccttatgagtgggggaaaaaattccattcaaacatttaattcagagaaattgctagcatttttgagagtcttaccctaatctggctacttactctgtgtctatgtgtactgggagaaagaggataatgagaaatttaaattcataagtattaactgttagatgattattaaattagctcatcatttctaagcatgaactgggcaggaagcatcatgtctatgcaggggaaagcccctatgttcaggagggacctgagatccgtgttccgcttgtctgaatctgccatccattatcctgattgttttcaaacagctttactgaggtataactgacatacaaaaaaaagtgcatgtacttaatgtatgcattttgaagagtctggatacatgcacagactcgtgacaccatcaccacaatcaaggtaacagacatatccgtcacctctaaaagtctcgtgtcccccttttttggtggcaagaacattaacatgagatctactctcaatacatttttaagtatacaatgcagtattgttaactacaggtgctatgctgtccagcagatctccacaacttactcgtcttgcagaactgaaactttataccaattggaaaatgcctccccattttcctctcccccatcccgtggtaaccattcttttatccatcctcctgtgatcttgggcaagtaactccctctttttggcttcagttctcctacctttaaaataaagaattttgaaaggttgacctctaagctccttttgcctttggtattccatgctcttagtccatgatggctggaatagaccccctaagtcatgagacccaaggcaaaataaaaacacaggacctcggcctggcacggtggctcacgcctgtaatcccagcactttcggaggccgaggcgggcggatcacaaggtcaggagatcgagaccatcctggctgaaacggtgaaaccccttatctattaaaaaatacaaaaaaattagccgggcgtggtggcaggcacctgtagtcccagctacttgggagactgaggcaggagaatggcgtgaaccggggaggcggagcttgcagtgagccgagatcgcgccactgcactccagcctgggtgacagagtgagactccatctcaaaaacaaaaaaaaacaaaaaaaacaaaaacacaacaaaaaaaacacacaggacctcttatgcaaaattaattaagaatcttaggatgctgacaacagaaattcaaacaagtgcagagccatggagctgtgtgtgactgcacaggccgcatgtccatgaagccgaccctgctgatggcagaaggccaaggacaaacaccaccaaccaaaataaaaaattctcagttatacaatagacaagttctgaggagctaatggacagcacgggtggggaatgatgtgttcattcatttgtgtaatgtcatcatcacacaatgtatgtgtatatcaaatcatcacaccttgaacacattgaatacattcaacctttatattccaactaaacgttttaaattattttttaaaaagtgtttgagaggccaagcatgtatatttaagaattattcacaaagtagataaaacacctgtcaacaaaaacagccatactcgggttgaatgattaaaaacgagcaacaacttccttttcttttcttttttctttttttttttttttttttgagatagagtctcgctctgtttcccaggctggagtgcagtggcgccatcttggctcactgcaagctccgccccccgggttcacgccattctcttgcctcagcctctggagtagctgggactacaggcacccaccaccatgcccggctaattttttgtatttttagtagagacggagtttcaccgtgttagccaggatggtctcaatctcctgacctcgtgatcccgccccccccccccccccccccccgcctcggcctcccaaagtgctgggattacaggtgtgagccaccacgcctggccaacaactgccttttcataattgatcacaatcagcttctattttataactacgtcttggaataggccattatgcttggatttcacaggcaagtctgcattttcctcgtcttaaattccatcgcggtgagccaaactcagtcaaccttttctgtgctaacatctgtgatcaagattaaagtaactaacagccagctctggctcttgaagcataactggaggataagatcaggtatttgcaaagtgtgaggctccagccacactcctctgcttcaaggacttgatgttgccttgactatcgttactctgaacactgggaggagaggaccatcatggagggagaaattgagtccacctccctcctttgaattaattgcaggagtaaacaaccacagaccacgtaacctccctttcacagagctcggctgtacagaacagcctagaatagtagggagagacaggtgccccgggtttaccaccagagcctatttttctctgtattcatttctaatgaatgagattatttctagggttgagaagcagggccagctgattgtcacaatcaggcatattaaaagccatgataggccgggtgcagtggctcaaacctgtaatgccagcactttgggaggctgatgtgggcagatcacctgaggtcagcagtttgagaccagcctaagcaacatggcaaaaccccgtctctactaaaaatacaaaaaaattagccaggcatggtggcgcacatctgcaatcccagatactcgggaggctgaggcagaagaatcgcttgagcccaggaggtggaggttgcagtgagctgagattgtgccactgcactccagcttgggtgactgagcaagactccttctcaaaaaaaaaaaaaaaaaaaaaaaaaaaagaaggtgtgataaataacactaggcaagaaatgcaagagcagaaaaaaaattatcaaaaaagaggcagatttttattttttaaagggactccagggtcactgagtgaagagctacagcatttttgatgcccgtgcgcaaccatcagtgcttttagcagaatctaaaacctagtgcttgaaatgatggctggattcttcaaggaaggcttcacacacattcagcgtactctatttgagaaggcaggaaaataaatgggtgatagagtttagaaaaattccttaaaagtaaagcttaactctccagaaatgaggctcccaaagcctccaaaacgctccagatggctgaagttttgctggaggtatgcgtgtgtgcatgttcacattttgtagcatttctatgtactgcttttaaaaatccatccttatcacaggccttcttagaacagtggtttgcaaactttttcagtaaagggtcagacagttaagattttcagtttagcaggccacgtgatctctctcacaacggctcagctctgccgctgtagctcaaaacagacatagacgagtacgtaacaaatgggcgaggctgtgttccaataaaactccacttacaaaaacagatggctggcagcatttagcccatgagccgtagtttatcaagccctgctctgccacaaggaacatgggctctggacagggcaggatctggattcaaattatttcaatccaccactctgtaaccgtgagactcagtttccctcttttaccatggggggatataatacattgctgcgtaactgtaaacatcaattggaaaacatagtagatatttgatacatgttaacgtccttatgccaatagtaaatcttttcatcttgctggttttcttagttctttatctatacgggtcttcatccacatggttcttttcagtcaaaaatggcctttctccaacattatctcattgccccacccttttcccctctcatattccacaaggctggtagacagacatcactaactgctctactgataaggaaataaacactcatggaagtagtactccagccagggtagggaattacgtgctccaaaccagcaacctgtgcctccgggtctgttacttgcacaaacatggacacccgtgagtttgtagacatgcccacttggaaatctacacatggacacagaagaggcagttaaccatcacagggaggggcaccaggcttggatcccaccttggtgacatacagattgtgtatccccaggcaaggtacctgaccacacagtctgggtttcctcatttatgaaatgaggctaaaaatagcataggttccagaagtttctacctcaaaatgttgagcgtctaacacctagcccatagtacatgttccatcaatagctgttgaatgaaccaatgtgatggtgagggttaaatgagaacagtattcatagccccaggatgctcaataaatggtcacagctctgcttagtgacaaatctatatgcaccacatatggaggtagatacacacacacacacacacacacacacacacacagctgtcagctccacatgggcaggagccatatctgacacaaagcacttgctcattacaaaactgtgtgttcatttatgaatatacaacacactcgtgcgtataaacaaataagtgcaaacagctgataaactgggttgggctccccaaggtccttgcaattctctctctacatccactcaacccccagaaggagcagaacaggttgatccagacctcagatgatgaaattctgctggctgtttactggattccagaccaccaccacccatacatatcaaagacccgcatcgtttcactccctgggctgtgactccagggtcccataaggtgacccaggctagaggtgccatagaaaatgtccctgctgggccaggcatggtggctcacacctgtaatcctagcactttgggaggccgaggcaggcagatctcctaaggtcaggagttcgagaccagcctggccaacagggcaaaaccccgtctctactaaaaataaaaaaaaaaaaaattagctggatatggtgatacatgcctgtaattccagctactcgggaggctgaggcaggagaatcgcttgaacccgggaggcggaggtagtaatgagccaagatcgcgccattgcactccagcatgggggacaaagcaagactccctctcggaaaaaaaaaaaagaaaagaaaagaaaatgtccctacttaagatgtagaggagcaaggggcagtgatatcctcaatgcgcatatcaggtggcgtttgagcacctgaggagtttcagggactgctgcccttgaattgctgagatgaggttctacctttgaacaaagatggtccgtgcatttggaaggaaagagctgacagatgttccaccgccctgcacaaagggagggcttatgctcaaccaggtcctggccattcccatgggcagagcaggcagccactgggcactgccagcttttcccaatatctcctccgagtccccacagccccttggctctgtgcacaggcgaggccgcctctaaagccaagaaggcaatgacccaactctggaggagggggagatgactcaagctacagcacacaaggccttctcagggccgccttgaccatgccggcctcaatcccaggcagttgccttcaccacaccaaggtagagtactcggcacttggacagtggcgtcagaacaagggtggaggccatgtcctctcggcatgacatcaactaacagcctggctccttggccctgaaagagaatgagccaatgtctgcctctggccatgcaaaaccaatcctcatttagtctgtggaaacagtacatggaaggccagatgtagcctttggcttgaagaactgagtttgctcaacagacacacgttttccattcaacactctttctgatttggttgcggttgtactgctgttgtttaaaggagggagggattaaaccaccctttttgagaggataaatgtgtggtgggtctgtatatgttgatgacagacagatacacacacacatatggtagatgttaacgagcccattttattgatgggcacactgaggattgaccaggtgaatgacttatctcagattgagtccacagccaggactcaaaccaagatataattccactgtccacttttccccaccacactgtggtataaggcctaaaattaatattatgtgctgccttgacacctggggaaagccaagagcatctcatatggcttgaatgtaagtttccctaactactttgcttcctcaaataaggtcctctagccagacagcctcctttgtctcagcaagaccaggtacagtgcctgcctatccctggagagtgggtttctgttccctgccagcctctgggattatttaaacaagacaatcatatccccttgtgggacacagggattattgcatcttcttgcttctgcatagcctgcctcccatggcccctggatgttcaccctgtccccagatacaaccgtgtggccctgcatggtgcacagcacctgcttccctggggctgactgtacgtgacacataaactgctgtccatctggtctgtccagctttgggtgttatccccatagggtgggaatctacttcaaccatggggtgaagtggaggcgatcaaaacacacaccaggctgggtgtagtggctcatgcctataatcccagcactttggaaggctgaagcgggcagatcacttgaggtcaggagtttgagaccagcctggccagcatggggaaaccctgactctactaaaaatacaaaaattagccgggcgtggtggtgtgctcctgtaatcccagctactcgggaggctgaggcagaagaatcacttggacccgggaagcggaggttgcagtgagccaagatcgtgccactgcgctccagcctgggtgacagagccagagtccatcacacacatacacacacacacacacacacacacacacacacacacacacacacggcttcctgagcaaagtgggactattacaatttccacagaatgatattccaaagtccctctctagaggtcagcttgcaacacacctccccacaggtggacactggtcagttttggaagagacaggagccaaggactctggccttcagataactaaacctcaagttcattcctagactggccatttatagtcatccagtagatactccatcattccattgtcactcttccacctgtctgtccgcaggagctccgaattctgcaacctccgcctttccgtgtgtagctcaagcagaatccagagagggcatgagcagtgggtaacaagggcagagtgtttgcaaacccaggaagaggtgacggcacaggcaattagaggcagaaccctgattaactgagcccaactaaccagaaccatcaattaactcaaatcttttttttttcttccctctcaggagactgaggccaggaattgagaaaatcacaatttaaaatggaaaaaaaactgtgttccgggcttttctctggctcaactctgacccaggtccatttccttcatcctcattcaagacacatgtacaacttcaaattttctagtagctgtgttttttaaaaaagtaaaaagaaattgattaatctatttgatttaaccaaatacatcctaaatattgtcatttcatcatgtgatccatatggaaaaagtatcaaatctaaacaaatatgaaaaagcattaaggagatgttttatattcttttgtttgagctaagtttttcctagagcacagctcagttggaactggctgcatttcaagtgctcagtaaccctgtgtggctggtggctaccatatgggacagcacagatctggagctaaagtgtgaagtgattgtttagaatgatgattctggagggttgctagggtttcaacgtccatgtcacctccaaaattcatgttgaaattaattaattaattaatttaatttattttttttttttttgagatgaagtctcactctgccgcccaggctggagtgcagtggagccatctgggctcactgcaacctctgcctcccgagttcaagcaattctcctgccccggcctcccaagtaactgggattacaggcatgtaccaccatgcctggcccatttttgtatttttagtagagatggggtttcaccatgttggccagactggtctcgaactcctgacttcaagtgatctgcccacctcggcctcccaaagtgctgggattaaaactgtgagccacacgcccggcctcatgttgaaatttaatccccaagggaagagtattaagtggtgggtcctttaggaggtgatcaggccagaagagttccgctatcatgcatggggttagtcccttacaaaaggtatggagagaactaagtaaaccccttttgcccttccatccctttcaccatgtgaggtcacagagttcatcccctacaaataatacagtgacaaggcaccatctcggaagcagagagcaaccctcaccagaccccaaacctgctggcaccttgatcttggacttcccagctttcagaactgtgagcaatacatttctgttgcctgtaacttactcagcagcataaacaacttaggccggggctttaaaacaaattggtcactagtgagtaactgcgtgctaagtgtttcctcccaacagtgcctcatgattgacaaactggtcttgggcttacacgggtctatgacgtcctggagtacagactgccaagtcccttctctacagccagggcctttcttcacaggaaagtgactgcagtaagagccacctgccatgacctccaccccattaattacctctttgtctgatttgcaatatgcaagccttctccataccttccacctaaatgatgaattcacacttcagaccaaaaaaaaaaaggaaattatttgaaaaggccatttttctactaaccacccaggaatgtgtaggtgtagcatttaatagtgcctacaaagtccctccccgaggggaccttgcagtctagcaaggacagtgagaagtacacatttaaaaaaagatctactattatcctggctaacatggtgaaatcccgtctctactaaaaatacaaaaaattagccaggcgtggtggcaggtgcctgtagtcccagctactcgggaggctgaggcaggagaatggcgtgaacctaggaggcggagcttgcagtgagctgagatcgcaccactgcattccagcctgggcgacagagcgagactccatctcaaaaaacaaaaacaaaaaaaagatcaactatttatgggtccaataaaaactagctactgggccaggcgtggtggttcacacctataatcccagcactctaggaggctgaggtgggtggattgcttgaagccaggagttcgaaatgagcctggccaacatggcataaccccatgtctactcaaaaatacaaaaatcagccgggcatggtggcgggtgcctctaatcccagctactcaggaggctgaggcacaagactcaactgaacgcggggacgttgcagtgagctgagattgcgccactgcacccagcctgggcgacagagtgagactctgtctcaaaaaaacaaaaaaacaataacaaacaaaaaaaaaactacctactggccacctggaacaagggttaaccaacatatgaggcagccccttttattggtgagaaaaccgagatcagaaaaatgaatgaattactatccacatgctcccacaggaactgcagaagagcgcagcccagaacacaggaagccttcccattttaaaatcattcatcgagtgtaatcccagcacttcgggaggccaaggcaggcagatcacctgaggtcaggagttcaggaccaccctgaccaacatggagaaaccatatctctactaaaaatacaaaattagcggggcatggtggcgggcgcctgtaatcaatcacagctactcaggagggtgaggcaggagaatcgctttaacccggaaggcagaagttgcagtgagccgagatagcgtcattgcactctagcctgggcaacgagagcaaaactccatctcaaaaaaaaaaaaaaaaatcattcattgagtaacttttccattttttgccctatccatgtaatgtctgttgttttatttatttttcagggctctttaaatcagctcatctatatttttacttcaatggcttaatttaaaagggaaacattactcctaaattagtggaaaaactagtataatttgctataaatggaaggtaactagaaaaataaacagagagctattaatttctataaagtctgtggagttatagcttaaaatcatcttgtgagtcaccagtttgcatgtgacactttggaaaaggctgcaacagagaagttgagacctacgctttgcctggctggctggcaagactttgtaaaggaagaagaggaaaggtgtcccaggtgtgtgcacagcatggagaaacgtgcggaggtggatggagggcagagcgtggaaggcagagaggaaactgatacctacctgattaaatcaccgaagcacattcagttccgtgccatggatttaacatggactaacacactttggaaatactttcaaagcaaggtctgcaacaatagtgtttttgtaactcctagttaacaagaaaaacaacagatccaagcccccacggcggttccccagtgtttcccaatactgtcatctgattctgttttctgtcagggaaataaaatatcccatttcctccatgatggtgagttctgaatgcagctgtccacggtcaggggagatggagaggaaagaagccaaaaagcagcaggcaggcaaaggccagtgagaagatgttgactctggggccccgtccttcactactgtgtggttgcgggtgtgggtatggatgtggatatggatgcgtgtacagatgcaggtgtgggtgtgcatgcatgtgtgtgagagagaaaacctcctcctcctaggctcaccccaggccatcaaagagacacacataccttgcagaaagtcaacttctacactggttggggcaagtccagcccgtccgaatcccacagggaagggccaccatggcttctaccccagccgagctgacatccccaaacacagggactttcgtatgtgtgtccgactggccttgctccctgccagtggctgcctcttcaggggccagaaaccctgatcgtgtcaagcagtcctagaaaaaatgctcacccgctttctcagatgaagtgcagtagggctccctggcctgcacaagccagtgaccatttttttaaaagcccttggaaaagaaaggcatatattctgcaacacaatatttggtggacactatcatagcattttgtaagatcgtatgtaaccccaactgtggctctgaacaaaaaaatattattcagccccagaaaggcatataaatccctacaaagtacagggtgggttttttgggtttttttaagtggttaaattctcacaattttttgcctttgttcagtgcagggagacagtggtctgcaaaggtggtaacactgacttcctgagaatcttttttctttgagacagggtcttactctgtcacccaggctaaagtgcagtggtgcagtcatggctcattgtagcctccacctcctgggttcaagccagcctcccacttcagcctcccaggtagctggaactataagcacatgccaccacacccagctaattttttatagagatgagagggggtctcactgcattgcccaggctggtctcaaactctagggctcaagcgattggccagcctcagcctcccaaagtgctaggattacaggcgtgagccaccatgcccggcctcctgagaacctttaattgaacttgcagcattgcaattcagcccaagctccttgggtgcaggacttcacgttgctaaatccagggaagcctaccttggttacctgggaaaatggtgtgggaggttccttagatctctccctagccacctgctccttaaaaacatcacaagaggttgtgggaccacaaacccttgtctccgagaattccttcttctctccaaacttgccctattcacacattcccgatcttattttttcctgagtcctactttgtctgttccacattttttctttttctttttttttttttttgtgagacagagtcttgctctgtcacccaggctggagcgcagtgacgccatctcggctcactccagcttctgtctccagggttcaagtgattcttctcagcctcccgagtagctgtgattacaggcatgcgccaccacgtccggctaatttttgtatttttagtagaaacggggtttcgccatgttggccaggctggtcttgaactcctgacctcacccacctcggcctcccaaagtgctgggattataggcgtgagccaccgcacccggcccccgttctacattttaatggccctcaaatctgtcccctcctttcctttcccactttccctgtcccagttcaggcctttatcataactcccctgaactgaatgtccccttttctgattccttgcctctaggctcacttctgcaatccattccccacgaagcagccagagtgatcatctcaaactgatcttggaccatgctcttctgctcctcaaacatcttcagtggctccccattacctacacgatacatctgaagctccctgatgtggtctacagtacctgggcctgtgcctgccttatcagtcccatcccctgccaaggcctgctcctctcttttacatctgacactttggaaaaggctgcaacaaaggagaagttgaaacctacgctttgccgggctggctggaaagactttataaaggaagaggagccttgtgctccatgaatattgtatttcttgtgattttctgacaaggctcaatattttcatctctgttctctgtcgggaatggtctttcgtgtccccttatcctggtcattcgtggcctgctcacattcacccttttttttgggacggagtctcgctctgttgcccaggctggagtgcagttagttcaagcaatgctcccgtctcagcttccaaagtagctgggactacaggtgcccaccaccacaactaactaatttttgcatttttagtagagacgggctttcaccatattggtcaggctggtcttaaactcctgacttcaggtgatccacccacttcggcctcccaaagtgctgggattatcattcacccgttaaggtcatgctgtgggcaacagctcctccaggaagccttccaggagtgttctaggttatactgcccactcctacatgatcacagaactgataacactccgcaagggagaaacatcagaaatctatcttacaaaaattcaactataaacagtcaggagggaaaaaagagagagatagatggtgacacaaatcatttaaataatgtggaatcctgtgcaccacttgactctgtgagtatataccctgtgatgaacatcttgctatgatttctctctccatctagcccagagtcatttttctggaatctgtgagtttggggatctatggagagagaattctgggggtcttcgaacttgtacatacccgctgatgaacttgtacatattcataattattttcactaactctaactgaaatttagcatgaccttcaattatgaatataggcaacagactgcagtagtattagcaacacccgagactttgacaccaacagaaattgcagatattttcatgtcacattgctttggtggcagatgtctccaaatattgtttatacttgtcattacttcaaaattagggtagttattagacctgatgccaaatctactttaatgtgttaataaagaagcaaatgtattattactccacagttttctgatttttatatatactttgacggctgtacttcaatataaccactttcctttttaatcctctgcatttttttgcatttgaaaatattcagagaaggggagcataattttgaccagattccgaagggatttacaacacagagaaggtgacactatcctgctgtagacagtgagctcactggtggcagggcaccaggtccttcatcttccaatccccagcacctaaagcagtggttagtatacaataggaatttttaaaaaatgaactgagatattttatctatctatccttttttccctccttccttcttccttccttccctccttccgtcttttctcccttccatctgtgtatccatcatcatccatccatcacctatccatccatccattcatccatcctccatccatcatctatccctccatcatacatccatccatgatgcatccatcaccccttgtccacccatccctctatccatccacccatccctctatccatccacccattcgtccacccatctattatccactcatttatctacccactcacctctctatccatctgcccacccatccacccacccatcctgtatccactcatccctctatccatccgcccatccctccatccaacatatatccatccatctgattcaatctacagttctaacagttgacacctctgcagttggtttcccagatccagttctgcagctcaactggagactccctaagaaggaaaagtgactcactgtggaaagaggtgatactatttccttgtatggccgtgggcatgtcacagaatgtgcctgcagctcagctgtctttcacaggctgaacacagagctctgtctccagctgccaccacatgggctggggccccaagctcaggcagagcgccatgcctgtgttcagatcatttccttacccaggaacattttggttttctgctttcgaggtatcacagaatggttaaatcttaaagaacaatcgccaccattaccaattacacaaactgcacagaatggtagttaagagttctgcgtaggtccaaagaccagctccccactcactctctatatgaccttgggtgactcagttaaccctttcctctctgtgcctcagttttgctatttgaaagagggcataacaaccatacctcacttacacaggtttatggggagattaaagagaatcttccttatgggaagactgagttaatccatgcactgcacttagcacaggggctggcacatagtaaatgctcaacaatttttagccatcattatccatcatttcctccaaggaggcagacaatcagaacattaggacccagaatcctgaaaaatggagctatggaattcacaaataccccatgtaaaaaaatgcttagatccactcatatctaaaattcaaatcaaggcagcaagatactgtttttactcattggtttgtcgaagattataaagatggacaatcaccagtgcctttgaaagaggaaacaggaaaccacgtaaggctttgaccggagatgtgaagaaacctcctcataggacaatataaaatttaaaatgcacacaccctttgagccagtgatgttaaatctagtcacttaccctacagaggtacatacccaatcgagcaaaggtgtatttacaagaatggctaaaggcagcatagtttaaaatagggggaaaaaaaccaatctaaatgtctaccaacaggaaatcagtgaaatagatgatgaaatatttagtgcatttaattaatctttattgaacagctactacatcccagagactgtgacaggtgctgaaaacagaactggacaaaatagaaaagttaaaaataacgacgaagaatgatatgtgctgacaggagatgagtgataagatagagaggaaaagcaagttaccataaaatatgtttcagaaaatacatgtcataaaatatgatgttccatttcaaggaaacaggttcctgccaatatgcacatgaatacactcatgtacacatattaaattggtgcacaaagtaattgcagttcttgccattacttttaaatggcaaaaacttcaataacttgtgcaccgacataatacaagttaaaatgcaaaggaaaaatctggaagtagtagcaaaaaaaaaattaacagcagttatctctgaagaataggtataggaagtgatgtgcttttgaatcatttaattgttttcatcatgtgcttgtattgcattaatcctctgtaggtcccgtatgctctatctcctttcagaacacatccagcatcaaactatttcatttttaatttttgtgtacacggagtaggtataaactacttcttttggctttcactattaacactctggtccaaaccacccctgcatgtcccctaacagattacaacatccttccccctcacccatctccctgttcttgcccttgacccattacagtacattttcagcagggcagccaccaatcccattttccaaggcaaggccatgtcattcctctgtttaaaatcctctgaagacttcccagtgtggagtgaagcaaggacccttctaagtttcccaaggttctaatgatctagcttcacctccaccgcccctctctcccttactcatgctgttctagccacaccaggctctgctggcaaccaacacaccaaccacattctatctcagggcctttgccctggctgctcctgttccttcctctttctgcagagctccaccactcatgcttttgagatctttgctcaaacactgctgcatggaattgtctccaccaaaggaaaagggcaacctatctccaactggccttacctagcccacagtcctcccctgctttgctctcccatgctctcatcgccatctgacatgacatatcaacatgcatttctcggttgggcgtggcggctcatgcctgtaatcccagcactttgggaggccgagacaggcagatcccatgaggttgggagttcgagaccagccgggccaacatggtgaaaccccatctctactaaaagtacaaaaattagttgggcgaggtggcgcgtgcctgtaatcccagctacccaggaggctgaggcaggagaatcgctggaacccgggagacggaggttgcagtgagccgagatcgcaccattgcactccagcctgggcaacagagagagaccctgtctcaaaaaaaaacacatgcgtttctcatttactacctgtatagaatgtgtgctcagaagagtaagaatttctgtcatgttggctgttgtatctccagctcctaaaacagtatccagaacgtagtaggcactcaacacatatttattgaatacactgatcaatattatcacatgataatatgatatgctattgataattgcgatgatgaaaagcaaatccagaaaaaaacttcgagtccctaaagaaaaatgtttataaaaacaaaacataaattttgaaaaaacatgtttccagtcacagctgcccgcagagaacagggtggaacacccaacaagaaagtaacacgtaaacacctcacggccaacatggcacacagcagcctggttgtctcaggcagctgctctgcacacaggaccctttcacagagtccagggagtaaatgccagcaagggttgaacatgttacaacgtcagcccctgaagccacagactattttcgggtgtcaggcaaacccacaatctcctgtgacagccaaactactgcagatctgaaaaccgtctccctgcggtctttcaggggacaggcctccgggattgtgccacgaactcctcttgcttcacggcacccagtgcctgctgcatcaacagcgactcaggcataggtgggcttggggtctccatcccccagatgtgagctggaggccctacatccttttgtgcctcaaggttgtgctggcgttttagttttaaaatgaaaaaaaagaataatttgagacaggatctcgctctatcacccaggctggagtgcagtagcgcaatcacagctcactgcaacctccatctcctggcctcaagtgatcctcccacctcagcctcccgagtagctgggactaaaagcacgggccactacacgcagattatgttttatttttttgtagagatggtcttgttatattgttcgggctagtctcaaactcctggcctcaggcaatccttccaccttggcttcccaaagtgttggcattacaggcatgagccaccatacccagtgtgcttggctttttaaatgagaagaggaatcaagagagcgttcttccgtacctcatcacacccacagtgaaacacttggcacatgctatcttgtttgtaactccaggtcacatgaggtcacttggaagcaaaaaattaaagcccaatgacatttacagggaggcgttcaaccagcagacttcacctaaacgtcaccagctccgtctcattacagtcaacgggtgttgatttttacacattctctgctacccatacttggttaggaccgtggttttcagctcaggggtgcttttgctccccagagatattcggcaatgtccagagacatttgtgagacaactggaggagggagtgtcattaaaatctagtgtgtacatgccagagatgctgctaaacattctacaatgcagagaacagcctcacaacaaagaataatcctgtcccaggccgggtgcctgtaatcccagcactttgggaggccaaggcgggcggatcacgaggtcaggagattgagaccatcctggctaacacggtgaaaccccgtctctactaaaaaatacaaaaaaaaaaaaaaaattagccgggcgtggtggcgggcgcctgtagtcccagctactcaggaggctgaggcaggagaatggcacgaacccgggaggtggagcttgcagtgagccgagatcacgccattgcactccatcctgggtgacagaaggagactccatctcaaaaaaaaaaaaaaaagaataatcctgtcccaaatgtcagtagtgcccagatcaagtgaccccaggttagtcagtccacagggtaaacaaggttgccctggggaagggagtcccttaagcactgtagtgaggctggaggcaaaagaatggggttgataagatctggtacaccttggggcttttgagatgtgtcttcgcagccaactgtctaaggattctttttttttttttgagacaggtctctgtcacccaagctggagtgcagtgtggtgatcttggctcactgcaacctctgccttccggattcaagtgattctcctgcctcagcctcccgagtagctgggactacaagcatgcgccaccacgcttggctaatttttatatttttagtagagacggtgtttcaccatgttggccaggctggtctcaaactcctggcctcaagtgatctgcctgcctcagcctcccaaagttctaggattatacataggcgtgagccactgcgcccggcctaacacaggcaagtccactacctggccatgtctgaacataccccaggccagaaaaggagcttcctcagcctgtgggtggcagaggtgagacccaaggggccagctgttggcccgtttttatttccttagaagatgtctcagcctctgctactctgaccactcgtcatccaggcagttctgggcttcactcatgtggtgacgacacagttcatctctgaactgcacgcaggcaaaaaatgtcccagcttgctcttgagacaagcacctagtttggctgccaaaaacatcctggtatttcaactcgtgctgcttccctctctgtaaagaggaaaccagctacctaaacagaggaggaggaacattccagagaaggcacaaagcaaatccctgcagagaatgccaaagtctttgccctctctgtggcacagggatgcaggaggcagtgcatggaggcacggaggctggagagcctctgctccccaagcctgctacttccacaagagagaaaaggcagggggtgacgcagcttgcattcacaagtgacaagagggtgtctccagcttatcctcttagcagtcctcatggctgctttaactagttgggaagctgaagctcagaagctaaaagcctttctcaaaggtgatgcactgagcaagtgaaagagttgggattcaaacgtaggactatgaaagtaatactaagtgcttaggtgccaggcactgttctgttgcttaatgcacgttaacccatctgatcatcccaacaagtctaggaggtggctactgctgttacttcaaccgtttttatttattattattatttttgagagagagtctcgctctgtcacccatggtggagtacagtggcttgatctcggctcactgcaacctccatttcctgggttcaagtgattctcctgcctcagcctcccgagtagctgggattataggcgtgtgccaccacacgtggctaatttttgtatttttagtaaagacggggtctcgccatgttggtcaggctggtcttgaacacctgaccccaggtgatccacctgccttggcctcccaaagtgctgggattacaggcgtgagccaccgagcccggcctactctgaccattttttaaagaaactgaggcacaaagggatcgctggcgtgtggaaggtctcacagcagctaagtggtgagccagggggtctgctgcatagaccatgacctgcccccacgaggcccgttctcacctccccaaggggctgcttggggttaccaggtccagactgcccttgtccactttgcaggtgagaccctaggaggatccagagtcctgagtgtgcaggggacaggacaaacaatacccaggggactgtcactgaggtgaatgaacgcagcaggccaggtggggacttctatgaaccagtgaccccatcccgaggccccatgcaaaggggcagctggtggtcaccagtcatggacatccagcagctcagagtggttttacctatcagtttttcaaaaatcttccaaccccactcttcccctctctaaaaatttaaaaaatttaaaaatcttcctgaggccaaaggcaacccatgtgcaggtcagagatggccacgaggaggcccatggcacaactttgagtccagggccatgaaatgagaaagtcacctcctgctcccataactggtgcctgattctaactgggccagtgaacgtggagactggtcatctgaccaagaactctctttgagcccgttttatagctggaagttccttcttctagcattgagctggctgggtttttccttctcaggacaataaaactgcatttctgtcctcgaccccacccatctggcacctgcaccacagctaacttcagctttccacccagttctcttttgttcagtggaaaaaatgagctacagttcccagaagaaaatgagaacggggttattattaataagatactctttttcagaaaggcagttgaaggcagcggggaagatcacattgaggggggagccggggtagccccactgctactccctcctgcaggaccacctggtctggagaagcagctacgcgctggccctccctgttggctctcagaggtacaaaccagaggtggcggcatttctaagaaattagattcaaatactaggacagttaacatttcctggaggtgtgaccgagaaccaagaaaaagtgattttgtgaaggccttgcttgcaggcagaaataacctgtcttctctgtctgtctgtctgctctgggggctaccggaaggagctgaaggcctgtcccccgcctctccccaccccaccatgccctaggccttagtccctccccactgaagaatgcctttaccaacttgggacagacagaggagtatgaatgaatgagaatactccaagctgaccctgcctggggcatctcttctcacacatgtggcttctctggtgctttatttagcatgagactgtttagaatgtttatttttggctcagttttgggggacagttttcacaaatagaatgacagctatgatcttctctctaaaaaaagagctcgtacaatccaccgttgggcattcagtttcaagagcttcactgtcccatggtctccattctgggacctctcctccactggaagaccctctcctttaatcaaaacatgacacaagatgacagtgactccccatggcaagtcccattggcagtgctgagccagcgaggcgggggcccggtcagggtccctgaaggaaagagatgttactctccaaactgaagagactgtacaaagagattctttataaggaaaactaacaagggaggtgctatgcaccagggctggccacagccaggagctgtcaccaccctggggcctgaaggggagggagtggtgttcctggaccacggagacagtagctgcagccacgggagagggcagccccacagcagctgtggccttgctaggggtacagacacagccaacccatggaaaccctcatctcatctcttcccaccttcctatctcctaccagttcctctacttggccaaagcaaagaaaagtccttgctgatgaaacccatcaaggttagcctctggaggcccagagaagaaaggagaggggtggagagtggatctggggctggggcttgcgggggaagaagacacccaacatgtttcatcttgctaacacccaacatggagacagcaggaggaggcacaaagagggcgtgcggggctgtggatcttccacgctgagcctccacctcccactatccctgagcagcagaggaatcctggtttgctactgagctgctgaacgactgggcaaattgttcagcagctctgggtcctggtttccttccatgtcaagtataaagatggaacccaacaggccctaaggtatgggagtcacagccagcactgcagaagagggaggcctaagtgtgggccctctcaatgccactcccaaactctgtggtcttggaccagggactgagcctctccatgcctcagtgtcttcacttgcaaaggaagggtgtgagagcaccttcgccaagggatgttgttatgaggaaacgaggtcacgcatataaagtgttgagcaacatcccaggcacatagaaaacatgcaatcacccctccagctctcacgttccccaagtttgggccttgtctacggatttttacatccctcatacacctggacctccctcgtgctgctatcttttgtgaaagcaattttcttcattgaatgattccattaactagaacctgcaaacccagcctgaacattctagcatcgaaaccttctcttttaagctccgcagtatgcacagccctgccccaaaaccccatggagaagatcgcttcagcttcaaagatcttggtgcgtgtgctatttatgccaaatgttagtgatgcctcctcgctgagcctccggctcgtaagtcaatgcaaaaccagccacactgccttgttgctcagtggcagcaccacgggcttctgcctcagtgcttgaagtcaatggcggtgggggtgccctgagagaagatgcgtgtgctggaagggaaatgtgagtatggcctcctcaaggtgccactgctgtgctcaccgtctgcagggcaaaccgtgccacagcctggggcttcagctactcatcctagaatccactctgtatggacagatgtttccaagcccatgtgctctggattgccaagtgagtgatctatagcaagcaagatctaatctatatccacatctaatacatatcaaatctctgtatcaataaatagatatcaaatctctatgtcaattctttgtgtcaaatctgtctagatctaatctctaatctccttctatatcttattgatatctctacctatcttgtaacatagcagggaaggagacagatttcatttgtcacctggctctagtttagattctatcacctactgaccgtacaacttttaaaaggaaacttggtctctctggctttagcaggctcctctgtaaaatggggttaaggttagtaactcccagggttatttcccaatatatgaaagctaaactgctaggttcaaatcttgctgcctttgctacctgttgggcaagtaacttaacctctttgcgcctcagtttctcatctgtaaaacggggatgacagtaatacttcccataagagatagttgtgaaatgcaaatgagcaaatccatgtaaagaacttaatttagaagagggactcgcatgcagtataaatgcttaattcatgttacataaaagtgctaaatttatgaatgcatgtccaatgtacagttcccatctcaatgaaacatctattcagtgtatgtaatcattattgacaagagtgatcttttttttttagacggagtctcgctctgttgcccaggctggagtgcagtggtgcaatctcagctcactgcaagctccgcctcccgggttcacgtcattctcctacctcagcctcccaaatagctgggactacaggcgcccaccaccacacccggctaatttttttgtatttttagtagagacggggtttcactgtgttagccaaaatggtctcaatctcctgacctcgtgatccgcctgcctcggcctcccaaagtggtgggattacaggcgtgagccaccgtgcccagccaagagtgatcattttaagtgttctgagttaagggcttaaattcaaactttcaatgtcttcggtgaagtccactcccaacaagaaggggggaatggtgatctcaacacgatctattttttgaaatggtgcatgtggctgcactttggggaacttgctggctatttgcggaatgttgtatcacatcattcaccctgagtcatacagactagagaagatcccatggccaggagatcgcagatcctctctgagaatgactccatgctccaagtccagactccctgtccattgagccaagtctctgcccaggcagtggtctggctggtcacctccctgccccaccagggctaactagagaggcagcaaatcacagccagaggaaaagattatagtaaagcaatctggtccctccccaaactagccttctctgccccagagaggttcttctcccataaggaggctgacgggggaaaaaaacatatgggctgagaagcaatttagtctcaccatcctctcaacagatgctgggcaccataagaattaatgggctggagactcaggtaagagccattcagaagcttcccgattactccaaaaactgctctctgtggaggaaaaggttaatcgaagcccagagccggaagaacggagaggagacagcaattgtgttaatcccaggagaggggaagagcttcacaagaaagaagtttgcacaaacaagcctgtggtctatccctgaaagaagaaccaggcctaaatatcaagatatttgaaagatcttctccatcagtccagagaccttggcaaacccctctccaaaccccagccaagtagctggattaagaaaaaaaaattttttttttaactctgcacattctttgcactagtaagccataaatctcttaggaaaccatctcctgatgaggtttcttctcccataatgatccaacagaactcagtttttaaacacatgatgtacatgttcctgtgtatcatgggtcattgtgtacccagagtcagtcatgtcaatgcaggtctggacacattagaagataaatgtgtcggccaggcatgtggctcatgcctgtaatcccagcacttttggaggccaagatggatggatcacgaggtcatgagttcgagaacagcctggccgacatggtgaaactccatttctactaaaaatacaaaaattagccaggtgtggtgtcacatgcctgtaatcccagctactcaggagactgaggcaggagaattgctttaacctgggaggcagaggttgcagtgagccaagatcacaccattgcattccagcctgggtgacagagcaagactctgtctcaaaaaaaataaataagtaaataaataagatgaatgtgtcacaaccacagcctacagctggttaaagtctgaacttaaaccagaaagggtgatgtttgaacataaacaagagaacaaacaaggaagttgcaattgtatggctggaagtgtctttgtaaaataaactgtcctcagaacaaacgaagttactccagggtttcctaaccttgccactactgacatttgaggctttttttttgggggggggtgctttcctgtgcattatgggatgtttagtagcatccctgatctctacccactagatgccagtagcatccttcaccccgaagttataataatcacaaatgttgggccaggtacagtggctcatgcctgcaattccagcactttgcgaggctgaggcgggcggactgcttgagcccagaagttcaagaccagtcggggcaacatagcaaaatcccacctctacaaaaattacaaaaattagcatacacctgtagtcccaactacttgggaggctgaggtgggagcccaggaggttgaagctgcagtgaaccgagatggagtcactgcacttccagcctggttgacagagtgacagagcaagactctctcaaaaagaaaaggaaaaagtctcaggtgattgtcagatgtctccttggcggtcaaaattgacctagttgagaactactggtttatacttaagtttaagttcagctgaacatcagtcagctaattagctattagccaaatttcagacatcagcccccagctcagcataacattgctaagatctaaagttcctccagccttccaaatgctcacatcagacattagtttcactggatggccctgaatttaagcctctctccttctctcctacctccttagtccttttctttctcccctgcctgataaagtaattctttattcatcttgacattataatgacacaaaagcactgaaggagcaaatgccttaattgaatctaagaataactggcattatttttataggaacccagacatactacgcaaaaaattcagaactctgtcattgggtctttttgcaaggttaacttttaactgtaagctcctcagcacatctcacctcctgggctcagaagctcaaacctcatctctccagctcagattcccccactacctgggagattttacaaccacctccactctacccagtcactctcttacaaacatgtttgtcttatttccatccacttattactatctgaagttacggatgcatttattaatatctatttgtacctttttcatctgactctcctagaatggatgctttctaggcaaggaaacttctgtttttctctgctgtatctttcacagttagcacaaggccttgtctccacatggcccaatagtgatttacggaataaggaaatagatgaatccctttacatagatacaatttctcaagtattaacttccattcatatcactactcatttgctacaggagccctgttcacaatcatcatggccccagcatcatctttaaatcatgtgaatgtcattcccttccctctaacccaagttagctgatcaaagaaattcaagtatctggttggttttgaaaacccagaagttgggagttttcctcctgatgcctttgatctccaggtcctgagggggatctcagcataaacgaagacctgcttccctctaactctagctgagttcacaaatacccagattgacaaatcttgactcggcaaaagagctcctttattatatctcccaacgtatctcagtgtttgagtggaggccattagctaattgacagagagcctgttgagggtgggggaagtgagggcaggaggaggcagagacactagaattaaatggcaagagaccttgccagttggagtggattcagaaatgatcaactgtcttggggatcgatgagaaagaaagaataaagtaataaggattccaatgtatcaaaacactactgatgcgcagggacatgttttgcttttgttcttttaaaataaattttcattcgggtccattgcttaaaccattttacccccaagccctctgacaaactgtcaaagataactcactgcgcaaagcattgaatctttctatccatctacccatcatgcatctctctacccatatatctaagtacatctgtggatagttgtgctaggcactgtctatctgtccgtctgtctatctatggacgttggattgcatataccaagcccatttctccagctttgcctgaatgttagcaaatctttctactagtcaaggcaactttattttcttgcaaaataggaaagcagttgagaagataagattctgatgtcatgcaaccctgagtctaatgtgcatcaacactatctgcttcctgtgtgaccctgggcaagttacttagcctctctgacccttaggtacctcatgtggaaatcgggtatcacacaaacacctgtgtaaccatggcatttgaggataaaatgagagaagtcagttcttggcaaatggtaaatgttagtaagaatgaggataagaataatgccacctagccactcactgaactccttttttatttttttttcatttctaggtcacctgattcgctggcagtcaccatctggagaccagaggagcattcatcactgcaagtcagggcttccttggtgcctccccaggggcagcctgccgagccgggaagctgacaccagggatttaaaccttcctcggcttcctcattctattaatctggccgttaagcagagagtcctgctgatgccaacagatgcaaagctctgctgtgctaatggtaaagagcattagaggagtcctcagcagccaatcaatccatctcccccaactcagaacagctgcacagggacagattaaccaagcgatggctgaggaccgttgcaattcacacgagggagagagggatgcgtgaaggaaagggcccctgcacagccgtgttctaatgcaggccaggtcttggacaagcaaagcggctgatgcattgtgcaaggacacagctctcagtgaaatctaacaggcaggctaacctgtgacagctgggctcaagatggagcaggcgatgctgtccttagaagccaagtgcactgggagaaaagcgggaactgacccagggctcagggtacatctgtcacctaacctctgcagagttaattcttccaagcttggccacatctgccatcttgttcatggcatatgggtaacatttgaggcactacttcctgccagaaagggacctgacccccttgtctgacctgcctgcaggcagctgaacaggatcccatcattcacctcacaatgggctgaggccagcacaaagtcagatctggccacgggcttgtgccaacagtcacaaagaaacatttgcactttggttgggttccaacatctctttaacatgggaaatcagaactcggggagcgagaacaatattcccaggctccccaaagacagggaaccaaatgagactgatggagcatcgtttgcagacaaattgaagctcttccccaatggcatagcacaaatgctgagagtctaccttgtgccattgctggttgcagatggaggttcaggtcccttgggctaacagattggactttaagagtcgccactgtgtaaggagctgctgctggaagcctcaggtgctggccaaagccactggtctgcaactcctctttcccatgagggttttgaagggctgatggggtggtgtccagagtgaaggatacaggaaggtcaaagacagaaccatccagggattctgctgttccactcccaggagataagatttgacttccagagttccggacacagatgttcgcccatgggttttcataagtttaatagggtatccttctggggaaggataaggaaaagaaggaccatcattttaaaaacacaccgtggaagttctctcatagtccctggggtagactgggtagagacacgtttcccaaagggtagcacacacatctctgataggaagtttaggtgacatcagagggtgcgtacaggaacaatattttcacagtttaatatctattttaatgttgtgcaaaaaaatatataactagcccttcaaacttgtggttccatgaatattattgcttgagacagtgtttctcaatctcaacaccattagtatttagggctggatcattcttttttgagaccgagtctcactctgtcacccaggctggagtgcagtggctcaatcttggctcactgcagcctctacctcctgggtccatgtgattctcctgcctcagcctcccaagtagctgggattacaggcacatactaccatgcctggctatgttttgtattttttttcagtagagatggggtttcaccatgttggccaggctggtctcgaactcctagcctcaagtgatctgcctacctcagccccccaaagtgctgggatacaggcgttagccaccgtgccaggcccaggaccagataattctttccagtggggagctggcctgtgtgttgtaggatatttaacagcaacctgggtctccacctactagatgccagttgtaaaccccccaaccagatgagaccaccaccaaatgtcttcagacgttgccaaataaccactgggaatcaaaaccaccccccggtttagaaccattagattaaggtaagtctatttctgaaagcaaagtgagttatgttaaggaaaaatgtatttttaggtgactttatagaatagatgaaatttacataaggcaaaggtggtcaaggtgataaggacagacaaaaccaagccagaggacagccaaacaggcagaggaaaccgaatccttttcctcctcagagctgcaccttctatacttccctgccggccctggcgcctggtcagccctggggcccccgtggctatacctgtgtgccagagaatgcaaggacagaaaagcacaaggaaactgtgaagatctgctggccttccccatcagggaggaagcaaggaaggtctcctcattcctcttaggagaacccaagcagagatgccaaggagagggcaaggacccaaggtggaggaggcaaaggccaggggagcaggtggtcttttccagtccaccccagaaacccttgaaatcgctgagctgtcattcagccttgaaacgttcgaacaggtttgactgtgtctgacacttgcaagctattcactgtggggctctgaacgaggcctgtcctgtctgcctactctctttactgtcagccaaacccaaagagctaaggaaatgattaatccaaagataagaaacgtccccttcagatccagcaggaaaagtaacagttctattggtttaaaaagctgccacttgccggacgcagtggctcatgcctgtaatcccagcactttgggaggccaaggtgagcggatcacaaggtcaggagatcaagaccatcctggctaacacggtgaaacctcgtctctagaaaaaatattaaaaaattagccgggcgtggcagcgtgcgcctgtagtcccagctgctggggaggctgagacagaagaatggcgtgaacccgggaggcagagcttgcagtaagccgagatcatgccactgcactccagcctgggcaacagagactcggtctcaaaaaaaaaaaaaaaaaaaaaaaaaaacgctaccactcacaagcacttagcacgtaccccggactttataaacatcatttcctgtgaccctcaaccacaactctgcaaggtgggcactatcactgggatgacgtttcagatgcgaagacactggcttagacattatgtggccccatgaacactgcagggctagaagacacagaggtggaattccacctggctctgttgaactccaaggcctatactcatagctgctgcactgtcctagctcccaggaaggcagaaagcagacagtcagggccgtgccctcccttacaagacccgctggtcatcctcctccccacacggaaatgccactgcaatcacaattcctcagaatggcctaacacgcaagcagatgaaagggtgcaacttccttccatatgctgccctcactgccaaggaataaaagtcctccaagttcaggcatcaaagagtagcatcttcccacttcatggctctcctctgtctcctctctcctttgcatgaacctccgcatgatggttgggcaggagcgaaggacagacgaaaactcaaaagaaatgattatggttctcgccacaggtgggaggggcaccagacacctgggtgcgaatgtgcacccatgcacacccacaccattgcacacacgtgtacactatatgccagtgtgtatacatacatgtgcaggcacacacacatccaaatgggaccaggggcagccatgggcctgtccagcctttcagagccacgggacaagtccccttgagagctggaatactaaggctgagataagtggccaagacaggaaagatacttacctgagtctccagggtgatgagcggacttgggtgtggatcctgtaggatgaaaggagaaaatgcacgtgaggagtgaaaaaaagttaacttactaccccagcatctttttctttctttcctttttttttttttttaagagacagggtctcgctttgttgcccaggctggagagcagtggcatgatcatagctcactcactgcagcctcgacctccagggctcaagtgatcctcccacctcagcctcccaagtagctatgactacaggcatgcactatcatgccaggcttttttaaaaaattatttttgtagagatggggtctcgctatgtttcccaggctgttctccaacactttggcctcaatgatcctcccacttcggccacccaacgtgctgggattataagcatgagccaccacgccaagctcccagcatcattttcaaacaaagcttgatttccccagtggtcaagccaccccacggggagggcagcccaacctgtgtcctccattctacagagacatcaggacagcttggcccagtctgcaggccgccccaacacttcctctcacgcacaagtgatgaaagaggctcaagtttttatgaaggaaatgcccacatggagatcacacaaaacaacaaaatgtaaagaaaaaagaaacaaggcacccttgccaaagagctcaacgtgtatccaaaccctctataaggagagtttggctccgtaagaggattaggaataaaccagaaagaatataaagtcctgactaggaacaaggccatcatcaatttgtgtctgatcttggaaagaacaagggaaggaatgagagcgagcagcttaatttctggtttgaggagcacattccatggtctggggaaggtctttttttaggatagagaaggccagagaaatgtcctattcattcactctgtacaaaagccgattgactgggaatgcttggtggtactgtctcgggtcattaagcatgaaccctttgggttggaggagagacagggagggtacaggaggaggaaaagactgatgggaggagttggtggtgtccagtgagtggtttccaaagaaaacaggaaacccagcacatgaaggctatttctgtctataccacgtctgctctgaacttaatcatcttggatttataattctgggaaaaacaacctcaagcttcctctgatagagaatgggcatgattttagggccctgaagtacacatccagtttgaagctttgctttgtcttagcagattttccaccacggggttttaggaagccatgcaaattagcaccagcccattgtcccatactgtgagcaagaaggaaatgcagggaaattggaactttctaaaccccttctctaggtgagctgccattcactgtcttgatgactgttctacggtatctttgtaatgatgcccaattctgaggagtgtaagaggcacgatctcagaaatacggtgagctctgctcagctctgtcctttaggaagaggaattcgtcgtcccccaactccaattctgagtccaactcccagtaattctccattggtgtaactgaaaggaaactgccaagagaacatcccactctaattctcacattcccccaggcattgagtcttcctcatacccaagaaaacatggaggggaatatgttctccccgtctccccacattgcagccttgacctataaaggaatctggggaagtcatgaaggagctgttttgggcctgtctcttcaaatccttactgattccttcccaggggtgaagaagtggcagctaggattggtaaaacccgacattcatagagcaactttcttttgatcaggcaggttttgtatcactcgcatgcagaaagagtctactctgtacttcctgtttccctgtgttggggcaggacccatttttgtctttgggaagcaagaccatcctcctggtctgtgggtggcagcatgagtcagacctggtacgagcttagtgggcgagagcatgcaacatctgctgttcaggtcagagtagtctgtgtctgtctgtctgtccattcagatcttaccacctcgattttgattataagataagaagctgcatctcagcctcaaaattagcctcaatctccaagccaagtgctagcaaagcaccagactggggtgttgggtgcatgcccagattaattaagctgtacttcacagaccatttggctattgtctgagacttaatgcttcattgcttagaatctccaagaggttgaagaggggagaatgccatcctgacccctaaaagcagctccaatggacaagactttccttgggaagtcacaggaaatctctgtcaactgtgttgacaaaatcaaaagcctgatctctagacacagtgaagcatcagctctctatttgatgttccaaaatcagagaccttatcagtgcatggtcagggatccaagattaagaagattctggaaagcaaaagcacaaatgctatctatttagcatcttcattaactaactgggaagaagataaagtcctcacaaggggccacatcattaatacttgggtttcacttgccagcatcattatgctctcctccctctgcacacactggaaatggaagactctccctaaagagcctcagtccagaggattcaaggtatgactatatatctgtgaggtctcgctttcagcaacatcctccttaattggaaaggctaacgaagtggaaccaggtcaatgatgctgtctgcctaatccatcctatctgtctaaattgggactctttggtttacagtagagtaaattcctgtccatcagaggaaagcctcctggagaccaaaggggaatttgcaatgtgcgtgcacgctacagtggagtgcttttagaatcttaatgccggtaccagtaaccatggaaccgcctacaacaaggaaagccctttcctatcatctattgcaatggctcagttggggaagtcaaatggggaaccaggtgcactgaattggtggccctcattcgtcacagctcctagatccatgccctctggtcatgtgactcgacagttctttactgtgtgcttctgcagcccttaagcttgggtttgcccatttgactgctttgcccaatgggaggttagtagatgtggcataagcagaagcttgaaatatgcttaggtgatcaagtgtggcctactgtgtttttgccattgccacaagagatcatgtccccagtaccttgctggtccaaggaggatgccagacacgtgaaacaaacctgtacacaatctacagcgtgcagccacgccccgcctagatcagccgaccccctgccaacacagagaaaatatatgcttgttgtttcaagccactgagttttgaagtcatttgttatacagcattattgtggcagtaactgatatactttctaaacactgacctcgatagatcaaaaagtgttgtcacaaacactcacagactcagaacctaaataatacatgctctttctctaagtctgcaaatgcatcccaggaacctgaaattactacagctaacagcgatcatttatagagggcctcctaggtgccaggccctgtgtgctagctctattattacatcaagcaaggaaataagtgaccatcaggatcttgcatgcctctgaattagccttcaatcctgtgtgcccaatataccagtccttctgaatttattatttagataccaacacaacatgacaggaaatgattactcagaatccttttgcctgaaaatacatacagttttcattcctttggtttattcttaactttgtcctatgggcatattacttgactgaggttctgaacagttgaatactagcaataaatgacatttgttaagttctcactatgttccaggcactgggcttaacttctatgcgtgtatcatttcgtttacccctgtaataaccctaagaggtagatactatcattatcactatcattagtatagagatggagaaactgatgaccagagagactggtaacctgtccgagtcacacagatgctgttgaaagcctggatctgatcccagcatcttacactggagaacactgggttccactctttcacaagagctctgctggaaaatatattattactttagacaaaataatcctacaatttttggataatgtctatcaaaatcaagaatacttacagcaaataagcagtaccaccttaacaaataccgtaatctttttttttttaccatctgtcttttttaaaaaggtagcggacatggttgatagaaattagcacacatatcatgactagaaacaaaacagtcactttgccacagcaaggaaccatgtaaagttagctaaatcaatccacacgtgtttactaagttccgattcagtagctagctctatgcgtggcaggcaccatgagggagacagaaatgagtttaaagtgactctgtgtacactgctattcccaaaggtaactgtttaaataagaggcaggagcctgattacaggtcttagagcaatgaaacttgtctacacctcaaaagtcttgcttgtaagaccaagaagccaggctcaaggccaaaggcttaattttaacaagcaattaagccccaacaaagaaagtagagagaggaggaggactttgttcgttatcattccacacatacatcaaacctatctggctctcctggcggattctgagccctgagctaagcctcagccattggaaagcatgttctcttcctttgctttgaggacattcagaagacagtgcttgttctttggtgttaggcaatgacattggtgtagagataatgacactggaactcacgccttcagagccaggtatctccgtgaagcccaccaaatcaacaacatagacaatggacatttacatgctaccttcttccacagacgctcccagggaacacttcagaaggctggcttggtgccttctctccgccaagagccctctaattaaggccagaactgggaatcttccaccatcaaaagatggtgtctcactgtcactcatcatccaaccaccagataacttggaaaatctaagaaactcttcttgggattgcagatcacagcgaatgaaaactcactcatgactcgagcctgctggagaatgtccagctctagccaagtctgaatgaccagccagaaacctaaagggacactgtcacttagctgcaggcctagtagtgcaggacaaagatgaattattcagtgggaaaagagggcaggtttaggggtcgccccagagttcaaaccatacataaccactgtattcatttgctagggctgctataataatacacaggtgaggtggcttaaacaacagagatttatcctttcacagttctggaggttgaaagtccaaggtcaaggtgtctgcaggtctggcttctgaggtctgattctcctcctagcctgtagagatggtggccttctcactgtttcctcacacagccttttctctatgcatcccgggtatctatgtgtcaaaatttcctcttctttttggggtgccagaaatggagtctcattctgtggcccagactgcagtgcagtggcacaatccaagctcactgcaacctccgcctcctgggttcaagcgattcccctgcctcagcctcccgagtagctgggattacaagtggttgccaccacgcccagctaattttttagaatatttttagtagagatggggtttcaccatgttagccaggctggtcttgaactcctgacctcaagtgatccacctgcttcagcctcccaaagtgccgggattacagctgtgcaccatcatgccaggctaatttttgtatttttagtagagatgggcttttgccgtgttggccaggctggtctcgaactcctgacctcaggtgatctgcctgcctcaccctcccaaagtgctgggattaaaggcatgagccaccaggcctggctcaaatttccttttcttataaacaaaccagtcagattggatgagggccccattaatttaatgcaatcacctcagtaaaggccttatctccaaatagtcacattttgaggtattgggggaggaagggtttcaacatatgaaattagggtgggggtacaattcagtccataacaaccacctagcaccacttgcgaccttgggcaaagtccttagcttctgtgagctttatttttctcactgacccccacgtaaacaggtaggattatacttgccaacagagctactgtaacaaagtggaaaacagattttctgggacctttttgtaagggacactattaataattatacaagcttaacaggtataaacccagactgtcccaggaaaccctaagataggctcctctttgtcttgaacacagcataccactgacatcatgagttgtcgtgaacattaaataaaaataaatactgtacatagttacaacctcagaaatgatcttctctttgatttcttcctccaggcttacaaaggctgagacatatccctctatactcaaccctactaaaccacaagtcttctgaactgcaagttaccgtagatacgagtgcaacctatgtcacgtgacggcagtgaactgagcaaatttagctaattcgttttgaatgcttactttatgccaagcatacgaaattcctgcaacgctgccaagggaggtatcatgatccccattttatagatcagataactgatactctcagagaataatttgctcaaaaacacagggctaatcaggaatggagccaggagcagtaagcaagtttgtaagttgccagaaactagtcctttaaccgatatcctggtgttaatcaaaagtatgaacttactgaatcagaatctctgggcaagggtccaaggaatctacattgttatgaaacacccttgggggattcttacgtacgctgaaccggagagactttacatgatacctaaactctaccatgtgtaatgcaagactgaaaaagcttccaaactgacaaagaatacgattcctgcctctgatccccagccagccatcaagtgtcggatgcatgcgtgaaactcttaagagcgttggtgttcacgctctgcacccccaagaaatttccaggacgggtgcaaagtgttcccttctccccactttggtgaagagatttgccttgccctaaaaaacctggctaccaccctccactttccagcatttcctcctcagggaagtgggactctttttcaactcctccttcttagggtctcattgcagcaaccaaggtgttgcataacggggctttctcttcagatgtccccatgggatttcacactggctcctaagacgaaggctgggcacgtgcagggcaggcggcatggggtgatgagggagggatgccagtgatacagaggtgtccttgttctctaaaaaagactgcatttggaatgtgaatgcaggccagaatcacacagccctcaccttgttggaaaatgtgaactcaccttcaaatagggctcaggggagaaaacagaaaccccacagagagaacaaggggattctcaatgttttacagaaacgttggcagttaaaactgggtgtattgcgcgctctctttctctcttttgtattaaaagcttaaaaagctggtctttctgctatcctactttcattctacatttttttagcccaggacccagaaatgagcagtagaaccttaaaatgaagcttaggcccttggagatggcaattcatcacccacagccttggaagatagagaaaccacagactcatggaaacttgggaattatcttaatgcttctccagcttggtatgtgtatccttgagcacaaatggttatcaaaaatctaaactcctgtatttaatactttgttctgtgtgtgcctcaagaggttttgtaattctttaaaaagtacacagaattaccatcttagaattacaaggttttgaagaaacctacctgaaaagattagaggcttgagctacagagtgttaagacaagaatgcccaactggtggcctgtggatgcttcaagctggtttgctttttttttttttttttggcctgcagccttgatgaaatacttgaaatcattcattgccaatgttttaaaaccaggatacttcacatgcaaatctagatttctcacgtctcctttaagaacagaagatttagcaacactggatgtgtattcttgcaagaaaacagctccagactgagtagctggcctggctactgcaagcaacagaatttatcacccccatattaatgcaaattgcctaaggtcacatagctagtcaatattgacaataatcaaaataccagctaacattgttctcacactgaatgccaggtattactgtaaggggtttgtaaatattatcttatttaattcttacaactgtctgggtgttgtggctcaagcctgtaatccgtggaggccaaggctgacggatcacttgcggtcaggaggtcgagactggcctgaccaatatggtgaaaccccatctctactaaaaatataaaacttagctgggcgtgttggtgcatacctgtagtcccagctacccaggaggctgaggcacgagaacagcttgaaccctggcggcagaggctgcagtgagccaagatagtgccactgcactccagcctgggtgacagactgggaccgtgtcttaaaacaaacaaacaaacaaacaaaccaaccttacaagaactccaggaggcaggcaccaaaagccccattttacagatggtgtaattgaggctcaaaggagaagtaattttttcaaactcattcattagtgggtggtgaagccaggatttgaaacagggcatccttttggaccactaagctaccctgcttcccagtggtacaaccacatcttgaactggaatcattaaaccacagttcctggttctatcagcatctggcactaagaagccataaggagcactgaattggatcagatgctcctcatactagatgttctcatttccttgctgcgagtcttcaggtcgactactttgctttttccagtggttaatggtaataatcatcaccatgatcctctcacactcattgtggagcactgactgagatgttctaccagagcccggctcagtcctgacagagtgggtgggccaccaatgttagttcctcttagaagacaattggcgacactttacagtgttttgcttttcacagctcagaggcatctcagaccataaacaagacctgccacgtgccaagaaggcagccgttacccgacatggcccagacaggaagtgctggctaaatcccaccatgccgcaaatctttctaaaggtggccacccaggctgtgtttgaacacacatcctcctggagctgggaacacacgccacatctataattcatcccgataattagcttttcccaggcacaggccgcagcacctatcaattttgcacccacttgctgtggtcaccaagatggcaggtggcccaactggaaccaatactgccaagtgtcccacagacattgtctggagttccaatgatactatgtgacttctgggactgctgggtgagatctctgttccacaggaaaatagttcatatttgagctccagaatccaaaatcgtgagttcaagaaaagcacttagaggtgcagaccagttatgcagcgaattcacaataagttgcccgaggcagctgttactaagcagtccacctggcctcaaattctcaatacggcccgaggagcagatattattaatagattccagtttccctagatgtccgtccctgacctgaatcaaacccatcactgtttggtgaggcatgggagatccaggaggaaaggcctatttcctaagggccacacacagtttggattaaaattcagtgtagaatgtcagttttttgataccaaatctggagttcatcccattttgccaaaataaatttctatgcacatccctccctgcttttcttcacttcctcctcttttgctccttcacaagagcctctgaccaggacatctattgtcgaagatacaggaaaactgtgattcagcagtgcttcgcgtctggaatgactccaagaggccacacacagaactgccgacacaaaccacggggggcggaaaaaacgatcccaggaggtggggagtggagagctttgcagtcccaggctacagctcgggatgtagagctgccttcctaggacagaagagagacgatgagaacacctggctggaaggtggccctgcaggggacggatgggccttctacatttagagtcaggatggagtcagaaagcttcagcaggggagggactctgcctgcagcctgtcccctcaacctcctctaatatttcttaatgaaacgatagtgacaatgaagatgacagccttgatgacagcgcccagtagaccgctatcattggttaagtccttatgagataccataattcaccatttatgagcattacttcaataaacccacattctatcctcatgaagtggctgttcccagaaggccataaagactggatagatagattttttttttttttttggtttttactttaaaaaaaaaaaacgacagggtcttgctctgctgcccagattggagtgcagtgatgtaatcatggctcaccacagccttgaacttctgggctcaagcaatccttccacctcaccctcccaagtagctgggactacaggcctgtgccaccacgcctggctaatatttcattttttgtagagatggggtcttcctatgttgcccaggctggtcttgaactcctggtctcaagtgatcctactgccttggcctcccgaattgctggaattgcaggcaagagtcagtgtgcccagtttgctttttctcttgatgacattaagtatttccttgttcctggattatgaataccctgtagtactgttcctaatttatataggaggaaactgaggctcagagagtttcaaagacttggttgaaagccacagagccaggcccatttaaccttaatatcttcagagaggtttaaaaaaaaaaagaaaaaaaggtaaccaaaatgcttggatgtggtatggtgtgatctgcatggtgcacaaaaatacttctttttttttttttttttttagatggagttttgcttgtcacgcaagctagagtgcagtggcgtgatctcggctcactgcaacctccacctcccgggttcaagcgattctcctgcctcagactcctgaggagctgggattacaggcacatgctactaagcctggctaatttttgaacaatactttttttaaaattaggtgccagcatttaaaatttagggtgaaatcatgatattctgatttgtggcttttcgtgaaatgtggaaagatctgacccactgggtaggcaggtccacttaaggcaggcacatccccttctgtttgccacaaccccaccctgcccacctgggctgagccctgaaagcatctaagtttatgaccttcctatctgttcaccaccataccttacccctcccccacaaaggaaggtaccatgttaccccatgaacatgactccaaccctcacccgccaacctcaagaagaaaaattcgggatcccgtgacttcacagcagaaacagaaaaactcaaataatccatcaggaagttgagcactgaggttaatacacacaggaccatcttcctctagctcaacagtcttgacttttcagggccgtgacccagaagggaggtgcccgtgcagaaggcagaacaggaagaggttcttagcacccactgttttctcttcctgcacagccgccttgggcagctgcctgtgaacagcctggctgtttttctcctagctctctcggaaggaagtgctctcatcacccacgacaacagagttggcccgaggagccaaaaacgtgcaaaggggctccaagcccagctctccttctgttcggggcagcctcagagacaggaagatgggaagaaagtatggcctgggatagaacatcctgcgagacccttacaaagccccagctgtgggggaagggaacaacaggagggggccagaggaagggggtccaggtcacaccaattttatacaatgagctcctttcatccgtgaatagaggactctccttaactctgtctcaatggctttgtttctgaaacgatcaattctacacccagaaagccaaatttgccagacctcatgccaaggtcaggcaagagcctgagatcccccaagcaagttgataatcaacacgcaggagacgacgctgtgctaagtcccatttggcggatccaaagcttacaacgatccgctttcatttctacgccttctgcagtggggcggggttgggggaccctcgctcacatgcatgccacgcttggtggaactgtaggctgtattcaggagagtaagtgttactttcccagggacttcattgagacatctgcggggagggcaggatgagaaagagctggagaaacaagatgcaaggtaaagtgtgtggtctcacactgaacacgttcatgaagtggtgggaagcaaccctagtgactcagcagtggcctctgtttagccagcactttgagaacacgatcttcatgggctgactgcagaggtggccaacagaaactggaatctacaagcagtattcagctcaggcatagtttgttcagcctgcacaatgttttaaaaagaacaacaaaaacctacataggatgccaatacttcacattcaggaggtttcccataaaactgcaaagttctggcattttttggaaaaatcagaagacctagctacacaaatccagcattttcctaaggcactgcctttctggcactggaaagcagctatctcccttagaagggtcacaggccctcctgcttgccacagtccccgccccagacacatgtccttcacttacggctgccagtgtggctgctgtgggcattggtgtttgtaatctctggtttagtggatcctaagctaagcccagcactttcagctggaggacctgaggttagagagaaggacgggatatgaaccatagacaggttgtaaagtaacgtggctgcaaagtccaagaataatttaactcaagaagcacctatgaatgcacacccaggaatacaaggcagagagcaaagttgactcccatggataggggtgagagtcctgtcttctcatcagcccctgctacatacttttgacaacttgtcccacttccccaggaccagggactatcttctttgtttttatgcttaatgaagtcctaagactgccacatagaaagcacttggtaaattcttgctgaaccaaaatcaacggaaacccaattcatgttataggtggaatctgagagatgtatgctgagaactcagccaacttctgagctgtaggatgttttcctgactgtaagtcaaggcaagtcctccctataaagaagagtttggggtataaatgacacagcagaaggagacaagctcaacctactgattggctaatgtctgagatgaggaagcagaaaggttagtctttataggatatgtagcatatctgatgagctatggtctgttaggaaggtactatacgtactaatttcataaaattgaagtatgttccaacttatcaaaggatgcaaaaactccacagaaggaaggaaggacctcatgtggtggcaggtgcagcatattttactgcaacctttctaggtctaaaaaggtaaaatgaggtttatcacatctgcttctgctgtgtatagccatggctagttttctccagctctgtttattaagagacagagagaaagaaagagagagtgtatgtgtgtgaatatgcatgtgtgtacacacacatatgtgagcatccacatgcacatacaggtatgcatgtgtggtctctttcattcaacacccccccaaaaaaagttgctatgggatctgtagattttgtttgctgagtatccctaattttggaattccctctgttctaagttgccccattcttggtactaatttcaaatggctgtgggggaggggaggctagcttcagacaagattccactaagagttttacttctgagctgggatagaagcaggaaagaataacaggaaaaacatgcagcatcccatctctgcactttgcatttagttataattattcacgcaggagcatctttaaacaccaaacgagggaaatattacagttgttctgatttcacatgctaactgtgtttacatgctaacagcatttctcagggacaattatcttattactagtgcactaatcttttcaatcttttcaacacattttacagctgcagacttcaaaaattaaggctaattaagaccttgctttcagcaggtacagtaaactactcacattccaacatggtaaaagaaaatcagtttaggggaaagggtgttagaggggcacagtgtcaatggcagacagaatacattagatagcttccatcagtgtgaggactacaactctcccaatgctaatgttcaagaacaagttccattaatggtaaggcctgtcgaattcaggaccaaggacagctggtctggcccatttttaagagaaagtgggtattttgcattcaattatccgtttccattcattatcttcttccgtgtgacttcagcatagaatagtggctaagaacatggaaacttgtatcagagtctctgtgtacaaatgccggctcaattattttccgtttgaacttgagcaaattacttgagatcttggtgcctcagtttcctcatatgcgaagtaggaataataataatgacatatacctacttcccaggcctgttattaggattcaccgaatatctgtaaagcacttacaacaatgtctgatcataataaatcatcaaatacgtatttcttttaaaaagtgtggtctataaggactaacaacaaacatctgttttctaacacgttcttgacctcacatgtactcactgcattatgggccatttgagggctgctaatatataatcatagctatatttattgtgcctgttagcaatacattctccagttacttgccctgctatctcattagctgccatataaaaccagcaccttggatcatccaatattattttttgttttgtttcgttttaaatcacagagaagcagaatgctctctgaagggctgttgttggaatccatattcacagtccagcttctcagatcccaagcaaaagctctggcatcccaagttgtggcgtctgagaaaccagtaatcagcgtctacagtgctcgggccactgacgttcatcaggcacctactatgtgcctcaacctaggcttgagaggctgctttttgaatgctcacaccaactctgtggggaagataatgctggccccattttatagatgaggaaactgaggcttcagacaattctacagccacaaaacttgtgaataaaacaaagttaccgtgtagtacacgtgtttcattctctccagccacacacttttaagccagctggcggaatttctcaagatgatgaatactattatttttactagctgtagaactcataataatggttgttaccatcaacaccaacatacagcatgtgccaggcactgacatattttactcacttaattctgacaactgcccttaaggaatggactcctattagcctctatttacagatgagggacctgggctcagagaggttatgccatgtgcccaaagtcacacagctgcacagtgttggagctagaatttgatcaaattcaggagatccagcttgagaacactgctcgtgaacactattctccagcctctcgtaatacctataaaattcaacaactgtctccttttcaatggacacataaggtatctttaacaagatagctacagggagtattgattccatcatcttatatcaaacaactgattgcaaaattggtgatttagttagatttgtgataaatgctgccaaaggggagaaggtagggacagaaaacacaggaacttcatccaggagagaagatcagaaaggttctttcagaaagggagaattaaactggctgccaaagaatgagtgagaatcaacttgtccaaggtagaggagaggacaagcattttaggcagaaggagaagcatgaataaaggctctgtggtgggaaggcactcataattttgaggacacaaagaaaggaagtctgaatctagaatcaacattgagaaggtgagtagcatatgataaagtggtaggatttggtgtaggggccaccaggtcagggagtccctttgggtgctaggaaggagcttgagtcttatccaaagagcaacagggagtcactgccaaagttcctgtgtagattgattggaatcttcatcaggatcagccttcactcctactccctagattataatatttggcttttacataatcagatccaaaggtacttctgaaaaccaactcagtgaatcagcacactgaagattttcaaaataagtctcaaataattcctattccccatttttagggatcatgatataacccacacggtctaagacattatgttgctactaccatgccgtactaattattcaaccctcagtattgttattacagacagaaaaaaaaaaacaagaggtgatatcttgtaacatgaaagtcaaaaaaaatcttttttctgtctaaaatagaaggacaaaaaaaatcaatctaggttagaaaacatcaatttgcaagagttctatggctgaggaaaatggcatgagtatttgtaggctgaaacaaatgagcagctaaaacatccccccaccacctcccacacataaccaaatgggacagactacttctggcatgtttccatttactcacacctacaatgtgctaggtgctatggtttatttcaaccccataaccagtgtgaccaagcatcccagcttgcctgggactgaggatatgggacgttcagcactaaaaatcaggcatatcccagaccaactaggacacactggtggctcaacctgcaacaaccacagctattaatataaggcagacacaggctcagagaggtggagacacttgttaatgtcacacagcaggtaaggggcagagaccaagattcaagttccagtccgtgcaacttcaaatcctataataacatttcttaggcacttattatggactaggtagtgctttaagcccatttagaagcattataagcattaattaatcctcgcaacatctctatgaagtacatactattctgggtcttgttttatagatggaaaattcaaagctaagattagctaataactcacccaaaatcccccagccaagagggacctggctttagtgcctatattgttaaccggcccatccaacagacccctgggcaaaaaccctgtcgcaatgcaaaaaaaaaaataaaattttagctgtttcttgttcaagataacatttaaaacacacacacacacacacacacagaaaagattagacgagaggtctggaaaaacaagttgctctgagtcttacagccaccacaaagcaggaattgctagtggctgctgatttacaaggctctctggtgaattacagaaagggaaatacagtcagatttgataaggctggtcaagttcggtgctcaagagcagtccatgatccagagaggccgggaacatgctcctgggccctcgtgcccatcagatcaatccccaccggccaggtggatgggtctgctgttgggacaggcagcctggaaccacatttccacgcttcagataaaggtggcttccggagcccggcctttcactaccatgccctgggggcaccacaggcaaagacccagacttgaacggctggagccactggtgtccctacgatgtatgtgcagggggaggtggcagtgttgaaaagggacggtcatcactgcaccaccattaccattagcattaatcactgagtgtgtttgcttgcgtcagagcctgtactgttaataaaccctgacctgtgtatccaaccactttacagagaaggaagtgggactgtggatcacagccagcgttgccctagggcttagaggggcccatcccactgtgctttcacgacctggtggcagtggttctcaaccaggggggtggttttgtcccccagggaacatttgacactgtctagagacacgcttatttgtcataacttgaaagggagcgtgtactggcacctagagggtagagacagggatggcgctccatatcctacaatgcacaggtcagctgatcctttatccagccccaaacatctatagtatggggctgagaaaccccaacctaagaggacagaggtaggccaaccacagccagccaagcttgcaggttgtgtccttccagacccttcctcagggtaccagccactcaaactagaagccagtgctcaagaggatgggtgatgtctcttttgctcacagctgcatctgaagggcctaaaacagatttggtgacttgtcttttctgttaaagaacagggacctggctgggcacagtggctcacgcctataatcccaacactttgagaggccaaggcaggaggatcacttgaggtcaggagttcaagaccggcctgaccaagatggtgaaaccccgtctccactaaaaacacaaatattagctgggcatcatggcttgcacctgtaatcccagctacttagaaagctgaggcaggagaatcgcttgaatccgggaggcggaggttgcagtgagccgagattgtgccattgcattccagcctgagcaacaagagcaaaactctgtctcaaaaaaaaaaaaaaaaaaaaaaaaaatagggaccaaatgacgaatgaacaagaaatgcacccaaccaggccaggtgtggtggctcacacctgtaatcccagcactgtgggaggccaaagcaggcagctcactttaggtcagaagttcgagaccagcctggccaatatggtgaaacaccatttcttctaaaaatacaaaaattagccgggcatggtggcacatgcctgtaatctcagctcctcaggaggctgaggcaggagaattgcttgaacccggaaggtggagggtgcagtgagccaagatcgcaccactgcactccagcctaggtgacagagtgagactctgcctcacacacacacacaaaattaggtactattctgggtcttgtttttatagatggaatagtcaaggctcagattaactaataactcacccaagatcccccagccaggaagaaggacctggttctagtgcctatgttgttaacctgcccatcaaacagacctgttgggacctcatgaggccagacactaaccccctgtcctcagctagacatggcgatagagttcccattgtctggatggcagaatcttcccatcactgcagtggttcaagacatccaggctctttgtttggcgggacagccagcctgctctattctcaggggaagggctttgagaatggcttatttagctcactccccaagaagcttatcaccccaaccccacccctgcccaacaaacacattcccatcaggaaagctggacgaccctgccttccatggaatggaagctatgatcccatccattcagttcagcctctcataaacgctctgttccaaacataaccagaatagtcagggagtcctcgaaacccagacatgacttattttctatttctagcttaaccacgtgatgcctgtgagtttcaagcactggagcatccccattcacgctggaaccatctcatctagaaaggggagggtgtacaagcagctctggatcagcccactggggttcagaacaagcaaaagaatttctttacctcccctgagtttcagcctcaaagagcagcaaagaacctggagcccattaaatccagctgtgctcattgtacaaagggaagaactgaggctttggaggacaaagaagatacccagatgatctgcattgctctttttctcccttgcttctttctctcttgttgaattggaataggtcaaacctgtctacagtactcaaatgtcacgggggtttcctccactaggcatggggcagagcttattctcaataaatgttcgagaatgaaacgtcagcaattaactagcaggcaactttggagaggatttcacttcccctataattaaacacaacaaatggcacgaatgttgaagggacaatatgcatgggtgtgtgtgagaaagaggaagagactgcagttcccataccaaataggtatttatttgttccaagacttttttttttcaccaaaaaatgctttaatataatcaccttttaaataatatacactgtcatcttgattatgtctattgggcttactcaaagaggccaggaccttgcagagaaatgagcctgaggtttccttctgccaggtcaccagtcaatggatatttcccaaaaggtggatcttttaatatatgactgcataatttaacctaaaatcctagttagtattctagcaagatgtctccttctaattgaggtaatttctaggaatatgttgctaaaagtttccttttcttcaaataaagcaataactgccatttatgaagcacgtattaggtgccaggtacttcactggccttaactctttgtaactcatgttttcaccgtcacgacaacactgtaaggcaaattacgaccagttcacagccaggaaaactgagactgaggcagaaaagtaactggcccagtgctgcagaaccagtaagaggctgagctggggttagaacctaggaatgactctcaagtccaagctctttatactgtattctcctaagctcagattaaaacccactccatcccctactttcttagtatttcttcatagacagaatatttcaaggaatttaacttttaccacaagggatacaaaacaaggaatgagaggacctgtcttacctccgctttatcacaaccactttgcaaagttactgagattcaacagctttgtctgctaaatgggcacatagcccttcaaccactcctttgctttgctgccagaaacaaaggaaaaggcaggaaaaaagtgcatatttcttccagaattgtcagaggccagcagatcttcctgcaggatgtcagcctaagcaatctttcaaatgctccccgggcaggcagcccaacccaccacactccgctccaaggagacacctcctaaaataaaccctgctaacttcagttagctcaccctaaagactatatatagaagaaaagactcaggagttcccatttggcagcagcttctccaaaactcagcgcaaatggctgatttctaacttaatctccaacatctgacaggcggctttaaatcagggaggccgactaagagatggaaaacctctgtgaggccagcccagcctgcctgggggcagagacaccccagggcttttcagcaaactggaatggcatgaaaatgggaacctggcccccggaggatgcgggagagaaattagacaaggtgtggtgggtgggagcaggatccagcccagccaggccactgggcatgttgtgggggtagctgggggtagaggacagtgatctgtacagaggcactgctgtgaattctgaatcttggtgtcttctgggcctcatgttatcctagagaataacagaaagccagggaaagctttgagtctccacatctatgaaatgaaggatatctctctctctctctctctctctctctctctctctcacacacacacacacacacacacacacacaccccttacctccagagagccagacattcactctcaagacacttttgaaaatactggtctttccaaagaccatcatttgtatttgtatttgaaagattgcttaggctgaattctgtaggaagacctgctggcctctgatagttctggaagaaatatgcacttttgtctccattttcctttgtgtctggcaacaatgctaagaggtggttggagggctgggagcagtgcctcacacctgtaatcccagcattttgggaggccaaggcaggcggatcacttgaggtcgggagttcgagaccagcctggccaacatggtgaaaccccatctctactaaaaacacaaaaattagctaggcatggtggtgcacacctgtaatcccagctattcgggaggctgaggcagaagaatcacctgaacccaggaggcggaggttgcagtgagctgagatcatgccactgaactccagcctgggcgacagacccagaatctgtctctaaataaataaataaacaaataaataaaaataaaaagaggtggttggagcgagatgtgcccatttagcagacgaagcagttgactctcagtaactctgcaaagtggttgtatatcccatggaaggatatacaagaaattgttagcaatgattcctttaaagacagagactggaaaagaaggagaagtctcctattttatatccttttctcatgggggaattttgttatcacatgcttatactccttatatttaaaaagcaagtgtcattcacagatggagggataataaggtggcttctcaaaaaattaaatatagaaaaactagatgtcaaatgctatataatcagcaattcctcctctgggttcacaacctagtgaaaagaaggggcttgaacagctattggcatatctgtgttcaaagcagcattactcacagtagctaaaaggggaaagctagcctagtgtccctcctggaagatctgcgtggataaaccaaatgcaatacacacataccatggactagtcagccttaaaaaggaaggaaattctgacacattccgtgacagggacaaacctcaaagacattatttatgctaagagaaaccagccagttacaaaaggacaaatactgtgtgattccacttataggaggtacttagcgtagtcaaaatcatagacacagaaagaagaatggcagtttccaggggctgggggtgagagtggacaatgaggggctatactttgttgtcgttgtttctttttttgtttgttttggcctgcaaagcgttttagaacttttcaattaatcgctaatgtttgaaactcagaaaatgtaaacaaatctagagtgagagaaagctcatcagttgtttgcctgtggatggggtttggggaagagggaggtagttattgtaaagagaaataagaaaatcctgggggtgatgttcattatatccaataatttggggtgatgatgtcacaggtggatacagatatcaaaactcatcaaattttacactttgaatatgcataatttatcacaagctaattacatttcaataaagctggacaattttatttatttcatgctattcaaacaaaaaagaaaaaaaagaacaaataaaaggcaacacctttttttttttttttttttttgaaatggagtctcactctgtcacccaagctggattggagcgcagtggcatgatctcggctcactgcaacctctgcctcccagtttcaagcaattctcctgcctcagcctcctgagctgggattacaggcatgcaccaccatgcctggctaatttttgtatttttaatagagacggggtttcactatgttggccaggctggtcttgaactcctgacctcaaatgatccacccacctcagcctcccaaagtgctgggaatacaggtgtgagccactgtgcctggtcgcaatatcttaataaaataaatggagattgaattattaatagaaaatgtctaacattttagttctgacagtctatgaaattgattctaaatccaaggaaacattacagaaggagaaattaagatttctaggaatgaatttatttactcaactaacagtggcaatggatgtgggctaacagtgcacttcaactttatctcagttaatcctcactgcaagcccatgaagcatctgttggtattttccccattgaacagatgacaatactgaggcacagagaggccaccttccagaattgggatgagggcagggatgattccagagtccatgctcttacccactgtgccgtgccccctccctcaattgtcattggacacccactatgtgctgggcactctcttggctagattcacagtgagagaagccactttgggccaaaaggctgcaagaaggggcaaatggagatgccggtatttgggcctctccatctttctggggtggaaagtatcactgcacatcatcacaggtacacggagagctccacggtgggcccatttcagcaagaggcattttaaggtcccaggaattgtccaaggcactgctgccccataaaactttctgtgatgatagaaacagtctctgtactgaccccagtggaactcactagccacacgtggctgcccaccacttgaaatgtggctgttacaaatgtggaattgcatttctaattctatttaagattactgaatttcagtgttaatgggaccccacacagagtggattgcacagtgtcactgtgtcagcagagcacagcctggagatcaaagcacagcacaaaggttggcatctcaggactcggggcaggccagccaagagtgcaaccagcacagcacatgggagatgaacttggccctacagaggagccagtgtaactgcctctgaatgcccccttatctacgtttgagtcaaccaggatactgagggccatgtggaccacaacacacatgctccagataacagtccccatactccagataacggtccccatactggcactcactatcccagacgtctcgtgcaagacactttagtgcattacttcctagagaccgcaagaaggagtaactcccatccccattacccaggtgaggaaactgaggtacagagaaatgaagcaacatactcaaggtcacagtcactggcaaagctgggatttgaacccaggaggtttgactgcagaggacaaatttcaaacaactacccagtcccatctcccaagacagagtcacaccatgccgcctgtcctgagacccacgtactcacttccaacaagctgcaggcagaggctttccttttggtgggaggagaaaagccaggcttcccatggagagagtgagaaagacacagtcacaatcccaagcacagggacagaccgttccttctaaaccaccgtcactagccacaaacacaggaaatgcacagcagcttcacatcttcctcctcattttgcacggcccattctctctgccaggaatcccttcttctcttgcccacctggaggattcatatttatccttcccaattcaagacgttttattggaaacctttcctgacctccgaagataagtagaccactccctcctcagctagctggttgcggtcactgccaccacgactctatcctgtaattacttctctctaagcacccatcttcctcactccactgtaacattcaagattccttgtggcaggggctgggtcttatccacttgttttcccagagccaaacagggtgtctgacatacggtcctggctcggcaactgttgacttgcaatggcaatgataagatgaatgatttcaacaaaaggaacatttacattttaagagctgaatcaagaactcgcttatgtcaaagaaagagactagtgagtatccctcaatgtcttgggcactggaaacaggccagggtgtgttttccaactcagctactttctataatagctgtgtgacccaaagtggaattttcttttttttttttgagacggagtttcactcttgttgcccaggccagagtgcaatggcaagatctcgactcactgtaacctctgcctcccaagttcaagtgattctcctgtctcagcctctcgagtagctgggattataggtgcccgccaccacgcctggctaatttttgtatttttagtagagacagggtttcgccatgtgggccaggctggtctcgccctcctgacctcaggtgatctgcctgcctccacctcccaaagtgctgggattataggcatgagccaccgcgccggcccctaagtgaagttttaacctcttaaagctttccggtttccctccataagatgaggataacattaggatcggcctctgggggttgctgggaggatcacctgggctaataatgtatgtaaaacacttggcatagaacctgggcttctataaagcagttccagccctgggcccaaaggatcagaatgaaagcaaatgagcaggtaggagttgatgctgtacaaccaatcccaggtaagtaggtggttttgccaatttcttctcctttagtcccaccaagttctgagagaccctgggcccattctgtctctcggctggccagacccggttttcaggggccctcagaaaagaggtcacccactgatcacctccctagctgaatctgactcttatatattttgttttgaactgcaaagtgtttttaaatttttcaattagccgccaatgttcaaagctcaggaagactgtgcattcaaattctggatgtctaaccttctttgaaaaattagatttggcctcactgggttcatactttgaattgactgaatctgagaggcactgtctacttcagatgtggtgtgggagtgcccagtccccatgtggccaggacacttgttctcactaccaaccctgcccagaaaacatctaactttgcaactcctgccctagggaaggaagttggccagaaataggctgttttatttagcaaagctattagctaaaagcagggagcagctccgagggtgagtaaaaatccgcattccaaactcatctgacttctctttgacagcaccggtatgtaaagatacagatgaattaatcattccgtttagtaataaactaaccctgttgttgctgcctctgtcatggagaaagcaaaaaatcaatcgctggtggaagcacttctcaatctacacctgacagaggggcgacagttagtgctgtcctattcccagcatcgggcctggaggaattcctgattttaggtgactgcagagtccttgaaggaggtaaaagctgctcacagcctgacagttctctgcatttactcccaaagaggagatgacggagcagagagacatgatccgatgaagagacaaacctgtccatgtcactcacctttatgtcttattggaagtgtcacctcttcgtagatgtgacaactgaacctagtaaatagaggcccccgctgcctgccccatccccataacacacataaacacacatacacacacacacacacacacacacacacacacacacacacacctatgtactccactgttggcctccctggaacatctgccagaggctgtaatatcttatttgttctcttgtgtgctcttttcagctatattatatgctgtacgaagaaagtagccttgtctgatttgatctgtttccagctacttgtctgtttctggcacctcacatagcccttggcacccaacgagcccttcctgaaaatttgcaaatgcatttttgacacaatacacggtattctgtaacgtttccaaacttccaatgcccatgcactagtttcacggtttttgccatatttctgtaccacccagtccagtaactcagtattttcttcaaccaactctcatcttgtagtgaaatagatctctttttaaaataaagctttacggccatgcatttggtcaatagagagacacctgtaattgatgagctctggagttgacagtcacctatgagcagtgtgaccctggacaagtgagttaacaacagtctatgaaattgattctaaatccaaggaaacactacagaaggagaaattaagatttctaggaatgaatttatttactcaactaacagtggcaatagatgtgggctaactgcacttcatctgcaaaacagcactaacaatagcacctactgaatacagaggtggttcaagggtaaatgacttaaaacatgtaaagttaatttacggcaagtgcttccaatagtgcctgccacagagccaacacgatatgaatactgcttgtattggtattatttaggggggaaaaccggtatcgctttaaataaatacatgacaattaaaaaaatcacttatgtaacagctgagaaacacttttggagacatgggctaagcctgagttttactgctacccaaatgtgaaaagcacccccttcgccaggtcctcatctcccatcttttaaatgaagatgttgggccgggcactctaagattccatccatcttccagttctgaatctctgactctcagtcatggataacactaccttaaaagaaataaaataggaaaaacctgaatttacacaataagctcaaaaggaaagagctggaggcggggaggttattcacattcccaaaggatttgcttttacaaagggattaacagcagagttgctttaaatagcagcttaagccttgtttatggattactagatacttgatggagaggtggaggggctcaggaacttggaacaaaagctttactacacccaggcagaaatgaaaaagcgcatatgttttctttaaaattacaatacacatcaacaggagaaatgattccatttcaaggaagctgattcctactcagtatttccgttgcatgtcaattgcatccaagaagatatgcctgtatccacgagccagtttagagcagtaatccagtgttcatatttttaagcccctattataagagcactgataatttattaaatgtcccaggcactgttgagcatatgacatgcattacctcatctaatcttcacagtaacccaataaggcaggtgtagttgtcatcatccttttacagatgaagaaactgaggctaagagaggggaagtgactcacccatgtcaaaagatggcaaatttaatagtcaagccaaagcgcatgaacctggctctgaggttagattataaaaggtaagatccttgtctcaaagagggcacagaacagccacggaggtcaacagactcagaggaggatgataaatgccccaagagacacctttgagggagcagaagaagaggatatcaaggtctagggtgtgcccaaagccaggagtgacctcatctgacccccaggtgtccatattcgagcatctctaaacactcagtgtatggattcctctcctccatccttcatgcatagaccctcttatctgtacctccctatgcacaaaccaatgtgtcctaggccactctattcccgaaaggtgggctgtgggactggaggcaaagagagaaagaacaactgttgcagggtctctgccagcacccacactgcttcactagactacctgagagcttcccattgcctggttttcctcctttgaaaaatggggatattcgccaccccccacctccctcagcagggaagcactagtgattaattaggtaacatctgtgaagcactcccagctttccggagaagggcaccttgggagaggagctataaaaacctgaggcacaggctattatcagcgtgatcattattatcatcattgtcattatgacattctcctgcccaaagacctgcagtggctcaccactgcccagagaagaaggtgccattggctgcctggcaggcaagggaaccgctgctaccccctccctggactctcccacccccatgcatctctaaccaataataccctatatgtgagtcctgcaacttccacatggaaccccttctcctcagagcagctccagtcttgcccggtccaagaacctttcctaaccacgtaggctggaagctcaacattggcatgcctatttctgctgtagacaccaagatttttctcctcgtgaagattctattcagaggaatacacaagtgcataaaaaacagtgatattgcatgagtttctcttttcccagagctataaaacaaagatgctacacaaaccatgactcagtatcttagactgatgctcgtgacttataatgggttagatccaataaacccaccgtaagctgaaaatagcctaagttgaaaatgcatttaacgcacctaacctaccgaatatcacagcttagccaaccctgccttaaacatgctcagaacactgacattagcctacaattaggcaaaatcatctaatacgaagcctagtttataatgaagtgttgaatactgtacatggacattttgcagacatgacaggatgctaaaacacaaaacacactatccaaatacatcgctagcctgagaaaagatcaaaactcaaaattcgaagtaaggcttctgctgaagatacatcgctttgcaccaacgtaaagttgtaagtcaaacccactgtgagtgactgtctgtgtctctgattagatgataagcatgtagaggaccagagagagttcagataaagtctacaattcatgaacagggcctcaggaactagttaagggaacaagcacggtctctgggttcagacagaccagagctccccattctgcctgtcaccacctccctgagccccaacttcttcctctgcaaaatggagaccagcatacttaatatgaacagttaaagaaaaaactaatccggattaagtaaggagaaacatcattggaaaggattattgcgaagggcagaaaggaaaaatcacactacggagggtgctttaccataagatcttaaggatcctgaagcatctcaaaggctaggcaaaaaggagttttcttttaacaaaaaggagaaacaaaagcaggtttggggaagaaaggatggtatgatcagagagtagatcagagaatgttttaccctgatgccagccttttctcaggaggggctgtgtgctggctcacgctcagtgtgggtcaaggcaaaagcacctggaggaagaagagagtctgatccaaagtctggtgatcaagcatgttgttctgattgatcagtgggaatgagcagccagctcatcctttataaggtaacaaatgggaatatgcagggtctgggtctagccctgtcctggggaaacaaaagggtatccacgagttgtagctaagtcacgtgggcaacactggttctttgcagcgaggcattttctgcaacacaaacaggtgagtggattcctttaacctttgttcttttgcaggagcacagggctcaagtaaaattcagcattgttgatccccaagaaagtggctgtgtagattcaatgtgccaatgcatagaaagcctttaacaaattgagtttttatcatttttatttttcttagagatagggtttcaccctgccactcaggctggagtgcagcggcacgatcctggctcacttcagcctcaacctcccgggctcaagtgatcctcccacctcagcctcctgagtagcgaggactacaggtacacgccaccacacctcgctactatttttgtttaattatggtttatctgcaggatagtatagaacaatcattgtaagaggcagaaggttgagaaaggagtacagacattctggaggtgtcttgcaaataaatatgcagccccggagtggatctgtttagccagccaggcatagaacacttctgactcacactggactttctgtctgatcagccccaggccatttttacatcatcttctcttaagcaagacaggtcttcagcctaaaacacatccaacatagtccctggcgattgagaagttcaaagaaaaataaagtgaaatatacagcccaccactgcaatccatccaagaatcaaagggtgtaggcttcaagacaggatggagaaccaggagttaaacaaaattctccactaactttttatcctctgctataatcagtggcatgcaaacctgttttaaatttaccgacagcttaagctgccacccaggtcttgaggtatttttagtcaactagaaattcatttagagcctgaagtcagggaagggaatcgtgtcaggtgtggctcctgcaggattcaggtcgtgccctgtacctgctttagttaccactcctcatttgcacacaattaaataatcacttcaccccctgcccatctcttcagcatcttcagcatctcctcacaaagcagcaggagaggggaataaaacgtcagggaagtcaactctaggtttaagagatctgttcttaatccgaacatcatttccattagcagaaacaaactcaacagggggaggcgagtacaaggaatatagggccctgagccgaaccaaaagagaacaaattcctctttccccactcaaaacaggcctatccaataaagttgcggctgtatgtacgtgaataagctgccagcaagaacgaggcagacacaggaggaatgaaattaatacttcggggtggggagtggtaagaaggtgcctaagtcgaaagcaaaaccacccaccctagtgtacaagccaagcatggaggaggcaccttcaatgcctctttatccttcaggcccctgtggccaacacatctccaattcactggtaagtcaacagagtctgtccagaacttgaaactgcctttgcaaaaacggtaacagtgagaaaattatgacagtgaaagaggtctgatctaaccaacccccatcttgcctttacctccaaaccgctcatgatcattcctgggcttgggtcaagctaactttcagagacatttagtttatactttaaaagataacagtccttccccaaaactaaaccacctttgtaaagctaatgtaggtccattaggttacaaggattaaaaggagccttggccaggggcagtggctcacgcctgtaatcccaacactttgggagcctgagattggtggattgcctgagctcaagagttcaaaaccagcctgggcaacatgacgaaactcccgtctctactaaaaatacaaaaaattagctaggcatggtggtgcgtgactgtaatcccagctactccagaggctgaggcaggagaatcgcttgaacctgggagatagaggttgcagtgagacaagatcaccccattgcactccagcatgggcgacagagcgagactccttctcaaaagaaaaaaaacaaaaacaaacaaacaaaaaacctgaattctgctagtgtaaaggattcccagccattattcctgaggtcacaagatttgcaacttccctgattcctcctgcagataacatcactcctgtagaacctaagattggccttttgagatgtcttttcaggtttttgcatttcttttatttaacacttgatatgaactaggggaagatttttacatttctgactatgatggcttgacccagacccaccaaccagtactgtgtcctcaccagaagaggaccattttccacccacccctgtgattgcatccccaaccaaccagcagcacccataactttgtccgccaaactatccttgaaaaacactagcctcaaaatttccagagagactgatttgaatcataaaactccagtctcccattcagccagttctgcatgaattaaactctctctattgcaattcccctgttttgataaaatcagccctatctggacagtgagcaaaataaacccactgggcaattacaaactgtccacttctgaccttgaccaccactatgctaacccaagtcccagtcatcttggatcccaacatccctttactcccagggtcctttcttcttccagcagccatcagaggcattgatagggcttggctgtgtccccacccaaaactcatcttgaattgtagctcccataattcccacatgtggtgggagggacccagtgagaaataactgagtcatgggggtagtttccccccatactgttctcatggtagtaagtctcacgagatctgatggttttataaggggtggttccccctttcacttggctcttattctctgttgcctgcctctacgtaagatgggcctttgctcctcatttgccttccgtcatgactgcaaggcctccacagccatgtggaacgttgagtcagttaaacctctttcatttataaattacccagtctcaatgtctttatttcgcagcatgagaaatgactaatacaggcacccttataaaatcataaaccaaagaacatacaacatagcaatttgtaaatcctacatgacttccccatctccctggaaataaaatctaaacttctctccttgatcataaagccctataggatcttacccctgcctgttcctcaagctcatctgacaccatgcttccttcttcctctgtgctccagcaccgatggccaaaggtttctagaacattccattctctctgccgcctcaaggccatttccctctgcctgggaggtttttcatccaagttttcacatggcttcctggtcgttgaggtctagggccaaatgtcacctccctcagggctctcttgggaccaccctcttcaacacatcctcctattttaatcccatgtataatatttgccatgttaacaggttctactttttttggtctgtttgatctctgtgtgttattcactgctgcatcctcatcgtgcacactagctgatactcctaaaaaatatttattgaatgaataaacgaccatcggaaggagaaaggaaaccccttctctctcaggaccccaaattcactatgccaaatgggagagttatgcttggaaactgagtcatgcaaaacactgcctttccctttgttcctaaacagacagctgcaagacagaaggccacatatctctccaggtggcctccctcgccttgacaatgtaaattaacagcttatcttcagaggtatgggacaaagacaagactagaaatcatcccccactgcccaccctaagacaaatgtatatttgacgtttccctccactttatgtttactttatcccatgtaaaatacagatttactgagcttgagacaaatatataagtgactgttcccctaccccctcctttcaaatgcaagatgtgggttcggtaagagttaattaaagcctcataagaatgtgacctctcacctcactccctaccttccctcttttctttccttcctccttcccctcctgcccactttttcccctttaaatacagagtcctcaaagccctctttggaaaaagcacaggccagatcctccagcgactttcatccctttttcctggggatgtcctcaaccttggcaaaagaaacctctaaactgattgaggcctgtggcagacactttggtttgcagaagaaaccacaactgtagcacatgatgtgagcaggtggatctgaaggtgatggtgtgtattttacatgacggcatacctcaatgtgtttattttttatttctataaatgtaaggggtgcaggagcaattctgttacatggataaactgtggagtggtgaagtgtgggcttttagtgtataccatcatccaaacggtgtacattatacccatgaagtaattctcatcatcccccccaaccaccctcccactcttcacagtctctagtatctatctcattccacactcaatgcctgtgtgtacacatatttagctcccactcccactgatgagatcatgctgtcatatctcaatgtagatgctaaatgttcaccagcaatacatgctacatctttagagttcggaaaaatgtcatatgagtctgggtgtggtggctcacatctgtaaccctagtgcttttggaggctaaggtgggaggactgtttaagcccaggagttcaagaccagcctgggaaacatagggagaccccatctcaaaagaattaattaattaattattattattattattattattttttgagatggagccttgctctgtcgcccaggctagagtgcagtggcgccatcttggctcactgcaagctccgcctcctgggttcacaccattctcctgcctcagcctcccgagtagctcggactacaggcgcccgccaccgcacctggctaattttttctatttttagtagagacggagtttcaccgtgttagccaggatggtctcgatctcctgacctcatgatccacccacctcggcctcccaaagtgctggcattacaggcatgagccaccacgcccggccaattgatttttttttaaatgtcaaatgaagtaaattctcagacccaagtagttccaaatatatttaataactgaatcaggtatcaggttttaaattaatgaaaatgaaataaaagtaaaacttcaatttctcactgctctagccacatttccagggctcctgatatagccccatgtggctgctggccacctcactggacggtacaggggtggctcatgtcacccaccacagcagcgatcaccgttgcagttcacggagaacagatttctactctgccttcatggaggtatcttctccatgggaggcagcggtggtctccacacgatccaccaagtccaaccctgccagctttttcattctgctctctcagagaagctgatatggcccagtgattccaatagggagcatctgggcagagtgccctggaggcagcagtccatcctcactgacatacagcacaactttacccactgtgcaagaagcacctgagcttccatgtcagaccatggaggaggacagcatttctggagataaataaagccaccacgcttagagaaaacaacagaggagggtgggaagagctctggccctggagctagaccgcctgggtttgaatcccagcagtgctactgaccagctatgtgaccttgggcacacaatttaacttctctatgactcagtttacctataggcaaaaggtcagcacctaccccttagaggagttgaaaaggacaaatgaaacagagtatataaagcatttgttgggctgggcatggtagctcatgcctgtaatctcaacactttgggaggccaaggcaggaagatcgcttgaggacaggagttcaacaccagcctgagcaagagagtgagatccctgcccatcccccctgtattagtccattttcacactgctatcaagaactacctgaggctgggtaatttataaagaaaagaggtttaactcactcacagttccacatgggctggggaggcctcaggaaacttacaatcgtggcagaagaggaagaggggcaaggcacatcttatacggcagcaggagagaatgagagtgaagggggaactgccaaacacttttaaagcatcagatctcatgagaactcactcactatcatgagaacagcatggggaaaacctcccccctcatccaatcacctcccaccaagtccctcctttggcacatggagattacaattcgagatgagagctggatggggacacagagccaaatcatatcaacccccacccacaccaatctcttaaatattaaaaaatggaagggtggtgcattcctgtagtcccagctacttgggaggctgaggcagaaagattacttgagcctaagaattcaaggctgcagtgagccatgatcgcaccactgcactccagcctgggcagcacagcgaaaccttatctctaaaaaaataaaaataatcacataaaacaaagcatatgtcacaagtgcctggcacatcacaatgactccctataaataatcataataattattcttgctcattataatactttgagctctgctcacagaagtacagaacaacacaggtgcccctgttaaactgaagccaaacttctaaagcagatcaattaccaggagatcattcacaatataaaggattctcatcggggactcctttaaatacagtgaaatctgtgaagggcttttcaaatcggaatcaatttaccatattgacatggaattcttcagggacccttcggggaaggactcagatgtagtgtcctctctgtcactctcatctgttggttggtgaacagcagactctgttcaccattcctacaatcagccaaggggggctgtgatgtttcacaaggcgccacggcagagagatgaaagttgttatgggtgctgttggattttagggctgctaagagaaccagatgtttaaaagtagccctgtgcaagtccaagccagagctgccaaattctcgacgcatgaaaaacaaaggcgtctggcttgggaaagtttgtcccaggcagactctctgagtctatttagaaagggttacaatgcaacgtttgtatctacacccctcctgtacaggtttgcaaaaccggaaataatgcctgtcactcatgcagtgactcctgggcacaaccttacagccagtccctgtgctgggcatcaaggaaatacagagatgacgtgaaatacctgctgggtgagccatagaagcaaagcgttatttgcttctgagtctgaaagctcagctgggtgaccttgggcatgttgcttaacctttctgtgattcagtcttctcatctgtgaaatggggatagcagcaggaccttccacacaaactcactgtgagaaatgagtaaagataaatgaaggggttggaacagctcctggcacacagtaagtgctcaataaatgtgtttattcttagttgtggtagtagactgctgataaggggctaaattcagggtgttagggtagtacataaaaaagctatctaggctgggcgcggtggctcacgcctataatcccaacactttgggaggccgaggcaggcagatcacttgaggtcaggagtttgagaccagcctggccaaacagtgaaaccctatctctactacaaatacaaaaaattagccgggcgtggtggcaggtacctgtaatcccagctactcgggaatctgaggcaggagaatggcttgaacccaggaggtgcaggttgcagtgagccaagatcaggccactgtactctggcctgggcagagtgggactccacctcagaaaaaaaagtatctaactagagtatcaggaaatgattaccatcccataccatagccagattcagctcgtggcctattttcgcaaataaaattttattggcacacagccacgttcatttgtttacatgttatctctggctgctttccggctgcagaggcacagttcagtagttgccaaggagactgaagggccctcaacatctaaaatacctcttatctgctcctttaagaaaaggctggccaacctctgatccaattcaattcaggagggatgtgatcagggaaggcttcctggagggtgacaacgtaaattttccttggttaatattgactcttgcatttcagagttattgaggaggatgcttggatcggcaggttcgggtaacagaaaggaaataagcattgccatcgacctctatctgaatcaaatcctacagcaggcatcacagaacggtggctcatgggcccagaaacagtctgcaatctaatttgatatgaacctgtggtgcttaaaaaacacccgagacaacattggatggctgggatacatcataataaaccgcctttccggcttctattaaaaactctgacgatctggcaaccctgggcccacccttcccatggagaccccttttgctggggtacctgttctccagatcaccatgagaaccttttcattcccccctttactctatgtctacagcctctgctctgatgctatcaaaggcctctcacacatattcttggttccctgccaacccaggcagacaaggcaagctgagaaaactaaagttcagagaggtcaagtgactttcctagggatagccatctggtgaatgataaagctggaccggaacctgagcctttgagtctagctcactgtccctcttcagacatacaaacagcggaatgagtcattgctacgattttactagggcactccatagtttgaatagctctttttttttttttttttttttgagacagtgtattgcccaggctggagtgcagtggtgcgatctcggctcactgcaacctctgcctcccgggttcaagcgattctcctgcctcagcctcctgagtagctgggattacaggcatgcaccaccattcccggctaatttttgtattattagtagagacggggtttcaccgtgttggtcaggctggctcaaactgctgatctcgtgaacagctctttcacatatacgagtccagattggaaaatgcagaccttggatccacggaggccacgtaaatattgagtggcatatggtcaccaaaggactgacaaggcaagaggctaaaactccagaaagataaggactagaagtgcatctagtctatctcaggagtcagagtgggcaaatctactgaatccaacaagcactgcttaagtgcctgctggaatcaagacaaagaaagaggcccagctccccatctggggcttagaatgtcacagggagggtgttacctgtaaagtaacaacgtaagaccgactgtgtttctgcaagactaaagggcagagacagctgaaacttcggtggcctacatggcagatttaaggacttactcagggcacaggtggagacgtggatttaagtgagtatgagtgatttttttcggggagtagatgatgggtgaaccatggcccttggatgatgtattcgtttcttgccagctgccataacaaagcaccactaaatggcttaaacaatcaaaatgtattgcctcccatttctggagcctagaaatctaagatcaaggtgttggtagggttggttccttttgaagcctgtgagaaagaatgttccatgcccctctcctggcttctggtggtctgctgggaatcttgaatgttccttcgcttgtagatacatcatgcccctctctgccttcgccttcacaaagtgtcctccctgtgtgcatggctatgtccaaatgtccccgcccccccccactgtttttttgttttgttttgttttgttttgtttttggcagagtcttgctctgtcacccaggctggagtgcagtggctcgatctcggctcattgcaacctctacctcccaggttcaggtgattctcctgcctcagcctcctgagtagctgggattacaggtgcatgccgccacacctggctaattaaaatgccccctttttataaggacaccagtcatattagcttagggacccccccgcttctagtatgactgcatctttgcaaattacatctgcaatgaccgtctttccaaacaaggtcaacttccaatgtactggaaatcgggacttcaacatatgaatctgggggcaggagaggggacataattcaacccataacagatgacatcctcaaagtcactgggaagcatggcaacggaggctgagatgctcaaggccatcctcgaggctcctccccacaaagggtaaagacctgggttctccctggcctttctgggcagaatgagagtccccagaggttctggtgctgttggaaggatcctaagcatcaagggaaggggtgtggacaactccaggcctccagcactgagagcaggagggaagccctgctccctcctcattacactgtggaaaacagaaaactcaatttatttaagaataaacaggctttaacctgaagttcattctcccgctccatgatgctttagcatctacatgcaaccgcagctgccagcatcatgccccggttgcacagtccgaaggacctatattggaaaaataatggcattttctcaacaaattatctcacagctgaagtaataacttgtttaaagatacgccaattcagattttcatccccttaacctgccactaaaagaaaagcggtgtcatccccatggcaaaacaggagcagtttaatcacttctgcacccctgtcctccggccctcgcccccaactccagcccccaccaccacccacagctgcacgtttattaattttaagccattgacagagtctctttggaaaccatgtttttttacttctcaggtcaacatcctccagctctgttataataaagtacacactgccagagataaagcaaatatttctttgggaaaggaaaacaaaatagagtggctgtgttttcaacacaatcgctaaggatccagccagcggacttcttctccaacagcagccatcaggctaactggccctcaccaggcttctcatttatttggcaacaaggaaatcacagcttcaaactctctcctggcaacagcagctttctcagtcttcggccaggtagacaggaaggacaggggctgacagtgaaaggaatgctgggagacacatcaagcattcaatcaacaaacagtgggtgcagctgaccctgtgcctggcactatgctagattctaggtacctcagtgactaacacaaattatagtacctactgtccccaaagaacttgcagtttaggggctgggcgccatggctcacacctgtaatcccagcactttgggaggccaaggtgggcagattatttgaggtcaggagtttgagaccagctagccaacatggtaaaaccctgtctctactaaaaatacaaaaattagctgggagtggtggcacgcgcctgtaatcccagctacttaggaggctgaggcatgagaatcacttgaacctgggaggcggaggttacagtgagctgagatcatgccatcacactccagcctgggtgacagaaagagactccatctcaaaaaaaaagaaagagagggagggagggagggaggaagggaggaaggaaggaaggaaggaaggaaggaaggaaggaaggaaggaaggaactaactaacttgcagtttaggaggagacacaggcaatgaatcaacccatcaaccttcaaagtcagcttgtaatgaaagccacgagtgaaagaaacaaggtgtggagttagagcgaggaaggccagccggaggaggggacacctgatctgaagtttgaaggacaaacgggaatcaaccctatattgggaaagtagtaaccctatactgggaagaggaaaaaaggggaagaaaaacagaagtaacagccagggggatgacataatccagctctctctcctctgtctctctgtctcactctctctttcatacacacacacacacacacacacacacacacctgtctacaatctattcttcagagtcaattctttaacattagtgtttgacaaaatgcaactctccctggaatgaattccaatcagccccagctcagtgtggatgagttttttcagagatcatggctggaaagcttgcaagggagatgatagcacatagggacactgggcccttgggctggaggatgttacaaaggaaaagggacgaggaagcaagggaaacggacttcagatcaatttccaaaacttccaccattctgccttgaggttgctgggaatggagccacccggggtgggagagtcttccagaaaagccagacggacttcctgcaagttcaatctctgcctaaatttatacagagagatatacttatgggcacatatttagcatttgcaagctgaagttgtggaaatggcacaagaactggccagggcaactttgagcttaccgatgtaactatgtgtagtgttctgcaactgagttttttgaggaaagggatggcttcttcaacatccttttctatgttcccgggcaggtaatttaacctctctttgtctctgttcctatatctgtaaaatgggaataacatcatccccacctcaaggagctgggaggggtaaattttaaaatgtatgctaagcactcagataatgcctggcctagttgttcaatgaagggttagtggctatggttattattattattattattattattatatcaacttccacaacatttaggagcactaaacatttatggaatgtttcttggccagtcagctcctgcttaaaaaattattacagaaataattagaaaataaaataaaagccataggcccaaagatatttacaacattatttatttagaatatcaacaaaaatctaaatgttcaacaattgagcaatggtgacattaaataaggtgcatcaacgcagtggtgaattatgcgctaattagcaggatcagcagagagatgacagaaaagctttaaaagtgtttctaggctgagcgtggtggctcacgcctgtaatcccaacacttcgggaggctgaggcaggtgaatagcttgagcccaggagttggagaccagcctggacaacatagcaaagccctgtttctacaaaaaaaaaaaacacacacacacacacacaaaaagttagccaggcatggtggtgcacacctgtagtcccagccaaccaggagactgaggcacaagggtcccttgagccggtgaggtcaaggctgcagtgagccgtcattgccccactgtactccagcctgggcaacggagaccttgtctcaaaaacaaaaacaaaaaaaaaagggtttacaaagcactattaagtgaatatgaaaaagacgaagtgtacacagtttaaaacaatgggtataaatacagaaagaaactgaagatgtgaaaattgcagttgggttggaatggtgggttatggataatgttttttaaaagatagtttacaacatgagaaaatacaaaataaactgcttgtggaaaaaataggattcaaacctatgaggggtttatttgggggctgttggagcatacagttcctcctttaagacatggacaaaaagaagctctctctcttgtctccatggcaaacacctaaatggaaggtgaaaatgcccatcattaagctctcttgatattgagcttgtcttattctacatacatgggtgtttgttttactatatccttttttttcttttctttttttttttttttaagagatagggtcttactctatcacccaggctggagtgcagtggcatgatcacagctcactgaaacctcaacctcctgggctcaagcaatcctgcttcagcttcctggaaagctggaactacaggcaacttccaccacacttggctattttaaaaattttttgtagagacagggtctcactctgttgcccaggatggatataccctattttctgatgaattaatagataaatgaatcacaaaatattcaccaggtgcttatgacatcaaaggcctgtgcggaatgaccatcatcccagcttccagagtgaggacctcaaatatgaagacgatacacagagacaaacaagtaactgatggtaataagccagccacagctaacacttaccaatgcttcctgcaggccagggatcactctatggattttatgggaatacctccctttaatcctcatatccagccttggatgcagctatagccatttgacagatgaggagacacactcacaaagggcaggcgtcttgcccaagtcatacaaccagtaagcggcaaaacctggctttgaacctacaaatcttctgccagggccggcgattttaacacctggattagtctgttttcacgctgctgataaagacataccagagactgggtaatttatcaagaaaaaaaggtttaatggactcacagttccaggtggctggcgaggcctcacaatcacggcagaaggtgaaagtcacgtcttacatggcaacaaacaagagagaatgagagagcttgtgtagggaaactcccctttataaaactatcagatctcatgagagtcactcactatcacaaaaacagcaccagaaagacctgcccccatgattcaataacctcccaccgggtccctcccacaacacgtgggggaatcatggcagctacaattcaagaagagacttgggtgtgaacatagccaaactgtatcactactctactgcagaagaagagccatgaaagctgttcacagcaggagaggcaaaaggccctttcctcaaagcccatctgggaatacctcacccttgtctcttctccagacacaattctccattgagagccgtcctccaagacctcaggttcataagggctagaagagcagcttgaaacgctggacttgccctttggagccagaggtcaggccaggtgggagccatccactagcaggttagagacaacgagattctctctgtgcagttcagaccacagccacagagaattatttaaacccctcctgggaaaccgcagcaacgtcagacagattcaatgtgcataactgtatgtgtgtgtgtctatgtgtggttggggggggggctcagggaggaggtgtgacaagcctgagtgacccaggagggactcagggcccaggaagggtcggatactcctcccccatccaggtgggacacagcgagctgagcagcccctgatgaaaccaaaagagtctcagatcctgtcccttttcctcctcagaactcagagcactggatcctttgttcagaaagcaagagaaaacaccaacacaattcctgctacagctgaggatgagggcgtggagcaggtcacacagacatactagcaagcctgcaaagtcaaaaccgtaacagccacagtaactgacacacgtcaacaactgacctggagccagatgttgccccatttaacctccaagactctcctgtgaggtgagaaccatgatcatccccattatacaggtgagaaaaccaaggctgatgggaattcatcacatggtgcataggaagcaaagccatgtttcgaatccaggaagcctctctgtcttaggaagacacgcacccactcatgcatgcaacaacagatgcacaagtaacagtcagagttggccaggcacaggggcagttgcctgtaattccaacaactcgggaggctgaggcgggaggacgacttgaggtcagcagttcaagaccagtttgggcatatattgagaccctgtctctaaaaaataaaaatttaaaaagaaaaacattcagagttgtgtacattcacaaaaggcatgcaaacatagcatagggatagaaatacaggcataaacgtgtgcagagagctgcaaccacgcgcatctgcccctcttctccaaataagggctgcctctttgcacacctctgagaggtgccctccacacagaatacaacatacacttgtaatattgccacacacaagcacataactttctggagggatgactcagattagaaaaacagcatttagagggcccctggttaatcaaacggcctcgccaccccgcgccacctctctacacagctgatgttgctgatcaatgtcgcggctgtgcagagggggcatttgataccacaaagggagccaactcctgctgaggaatgaatgtggcgcttgtcagctctgccccaggcagcagcacaacatgatgccctgtttctcctggaatcggggccctgcgtccgctccagccctcattttcatgtctttcttcccaacagacacaaggccggctcagttctggagaaacagcgtggctgccaaggcccagtggagggagaaggccttgaaaagtcactttataaagcatccgtgctcgcagcagccaagccacgaggccggagcggctgactttccattcgccacacaccccacccaaagacgagaactctgccacagccagcccttgttctcacccactgggagccctggggagttgaaatcacagggacagcagcagggagcccttggcagcaaacccagctcctggcatcttcctcgggggccgtagcttgctgtggtcagccgagccagtctgatgcaagaactgaatgacgcccattcactgtggtgccctcgtgagctgggagatgtccaggctgaggctggggcaggcaggctctctgtcacctgcagaggctgagacaacctcaaggtaggacgagaacccagggttgaagctagcagaagccaggccctggggcccctgatgcatgatgagagtgaaaagaagggcacagtgatgtaaagaattcctccatttcccctccctgccctcagttacttcctatccatacagaggggggatgaaaactttaagatttcactattcagctgagactggtgactcacgcctgaaatcccagcactttgggaggctgaggtgggtggatcacttgaggtcgggagtttgagaccagcctggccaacatggagaaaccccacttctactaaaaatacaaaaattagccaggcgtggtggtgcatgcctgtaatcccagctatttggaaggctgaggcaggagaatcgcttgaacctgggaggtggaggctgcaatgggctgagattgcaccactgcagcctagcctgggcaacagagtgagactctattttataaaaataagagactccactattcatgcattcacatgctcattcaacaaatattactgagcacctactatatgatgagtgttattgttttaggcactgggagtacattagtcaaataaatagtcaccacctgcatgtagcttgttctcaaaattctcaagctctcccaaccctccccataatgaacagctgtgtgacttagagcacactgcttcccctctctgtgctccagtgaggtctctcccagggttcctgtgaatcaccatctgggatccagtaagctcccccatggggcctaaactagactaagttggtttccgtcactcacagccagaggagtcctgcctaagaaattgggaaagagagcggagaagacaaaaagcaggtttgggaaggctgcagggagctgatgagtcatttgatcatctggaaagcagatgggaagacaagtggagaccaggaggccctggggaagagaagctgtgttcacgccaaccttccccagcaggcctcagaagctgggggtcaaaagggaccacaacgcccatttaaacaaggaggaagatgctgaacagctaaagggttaattcaaaagaaaaaacaaaagaagaaatggccatttcttttccttgttcactcaatgttccttcaacaaattattctatgtgcttggaatatatgaggccctgggttgggtgtggtatgcaacagaaaaataaaacataagaacatagtatgtctcttcccacagggtcatatggtctttcgaaagtcacccttttaatttgaaaccttttgctgcttctttatttttattttttaatttaatttttttgagacagagtcttgctctgtcacccaggctggaatgcagtgacgcaatctcggctcactgcaacctctgcctccggagttcaagcgattctcctgcctcagcctcccaagtagctgggattatagacccctgccaccaccccagctagtttttatatttttaggagagatggggtttcgccatgttggccagcagtcttgaactcctggcctcaggtgatctgcctgcctcggcctcccaaagtgctaggattacaggcaggagccactgcgtccagcctatttattcttattttaaaaatttatatatatgtgtatatatataaggggtataacacagcgttatttttaaggaataagagatattttgcttttcaaagtgcctgctaagcccagtgacatacgcttggttagcaatcactaaatgtggacacattataaatcctctatatattttatagagatggggtcttgctatgttgcccagtatggacatgcgttcctgggctcaactgatcctcctgctcagcctcccatgtgctgggattataggcatgagacagcagcactcagtctctttgtttatttctctgcctgctccccacccatctgtgtgacccctactaaaataaccactgcatggtgttcaaggaagagtatggccttgggattcaggcaggtctgcattctaacccagggccttctaccttctggctatgtgcccctgagcaagtaacttggcctctgctatggcttagatgtgtgtcccctccaaaccgcatgttgaaatttgatccccagtgttggaggtggggtctaatgggaggtgtttgggttttgagggtggatccctcatgaatagatcaataccctccttctattagttctgcaagagctggatgtttacaaacagtctggccttcccctccctctctcttgctttcttgcttacctgtaatatctgcacatgccaactccccttcaccttccactgtgagtgaagctgtcggaggccctcgccagatgcagatgcctaatcttgaacttaccagccatcagaatcacaaaccaaataaactttctttctttataaactacccagcatcagatattcctttatagtaatacaaaatatacgatgatagcctctcagagcctcaatcacctgccctggaaaatgggtacaacaccgagttctttttaaggaataaatgatgttttgcttttcaaagtgcatgctaagtaagtgcagtgacatacgcttggtaagcaatcattgagtgtgaacatattataaattctcatgaaatctaagaggcaaagccctgggaatatcacaatattgatcttctaaagtcagtatcagctttctcatggctcagactcactcctgagttttgtgcttggatacttaacaattgctcactcctaaatttcctaactagttccagcttcaaactggaaaaattcctccagtgtattcaagcctcgttgcctagcaccacaatatccttggttgatgtgcttctaggtgctaaaagaataggccggggatggtggcttaggccgataatcccagcacttttggaggccagggccggcggatcacctgaagtcaggagtttgagaccagcctgaccaacatggagaaaccccatctgtaataaaaatacaaaaattagctgggcgtgctggcacaggcctataatcccaactactcaggaggctgaggcaggagaatcgcttgaacccagaaggctgaggttgcggtgacccaagagatcgcaccattacactccagcccgggcaacaagagtgaaactccatctcaaaaaacaaaacaaaacaaaaaaaaagagtaacgagtgttagatattggtgggggtggcatcagaaggactttgtgtgacattcccaggtctgttctgagcgcaaaggccagatttagacagcgttgagaacccaaatgaggctctagaaactggtccaaacaatgtgcccataatgacacgtgtcaaaaccgaagaaggccttagtcaggggaaaaaagatgcaaattacaaagacctttttcagagccaccaccttctaaaagtgaacagaaggagcaggaagctgccaaagtgtaccagaacctcctccttcgacgctagaaagagtaacaggtcaagctccaacttgcaattcagttctattttgaagtttactggaaagcagaaaataagaagggatttgagagaggccggcagtttgaaggcaaggaggaactgaaataaacacattagacccaagaacacaaaagtcctagcagcttggacctgctatttctcgacagttcctccaggctcctcatgcataagccaatcagcaatgatgtgcatatttcagcaatgatgtgcataatattgatcttgaaccacagcgatcttcctagttccttttgccaggagaaaagatgggggtggccacacatttgagaaagaaagtccattaacattacccaagttggttttgaagtattgagacacttttttttttttttttttttttagatggagtctcactctgttgccaaggctggagtgcagtgacgtgatctcggctcactgcaacctctgcctatcgggttcatgtggttctcctgcttcaacctcccgagtagctgggagtacaggtgcccgccaccacgtccgactaatttttgtatgtttagtagagatggggtttcaccatgttggccatgctggtctcgaactcctgacctcaagtgatccacctgccttgccctcccaaagtgctgggattacaggtgtcagccaccacacccagctgagacacatttttagggtgtgtgtatgaccgagttttatggttgcaaacaaaagactccatgctgcccagttcaggcataaaaagaatgtcctgaataatgcaagatgatgtataggatgcttggacaaccaaagccaaatgtggaggctctgctgtgggtgatcatgtcccaaccacacggacactgaccagcacagaccctgtccctgctgctaatgagttcacactgccaccaccaggcacagacccaaatccttgaccgctgctggctgccccttttgccagaatggattctgtaccaggctagtttccccacataacttgctctttcaggaaatccaaaagtattgatacaaaaggtgtattagagccataagtgcatagagagaaaagcgggtacattaagctttgattctccactgcctgttgtaatagtttgttttcacgttgctgataaagacacatccgagactgggcaatttacaaaaagaggtttattggtctcacagttccatgtggctggagaggcctcacaaccatggcagaagatgaaaagcacatctcacatggcagcagacaagggaagagagagcttgtgcgggaaatttcccttttcaaaaccatcagatctcatgagactcattcactatcacgagaacagcgcaggaaagactcacccccatgattaaatcacctcccactgggttcctcccacgacatatgggaattgtgggagttacaattcaagatgagatctgggtggggacacagccaaaccatatcacctgtcattacttttttttttttttttttttgagatggaatctcactctgcggcccaagctggagtggtgtgatcttggctcactgcaacctctgcctcctaggttcaagcgattatcctgcctcagcctcctgaatagtttggatggcaggcgtatatcagcatgcccggctaattttgtatttttagtagagacagggtttcaccacgttggccaggctggtctcaaactcttgacctcaagccatctgtccacctcagcctcccaaagtgctgggattacaggcgtgagccaccatgcccagcagcctgccattactttcattagcaccaggcttcttgcatattttacagattgctgtcaatggtctaataaacaggtgtgttaacacatccagcagtaaagaaccggggccctcgaacctgcctgcctgggtctgaaccctgctccccagcccttacttgctggaagaccttgggcaaattattcaactcccatctgagaatattattcataacagcacccacctcatgggccagttgtgaaacttacagaagtcaatttaaaccaaggactgaacatagtacttgtaatatgagtttgtacaaaagtatcagttgctattgttgatgttgataataaaagctaaaataacattataacccccttcatggtggtagtttcttcataagctgccattaaagcaaagagctacctacttaatacaatttgctccctaattaattaattatatctaaatttcattgtattgtgtcattctacaaggaatgctgctactatcaccttgggctgctaaaaaaatgcccagtcactaaaaaaaattgcttagacggtattctctgtcatttctcccaacgaataggcagtttattattttttgaagaagtcttttggctgtgacaatggggcctcataacaatgaattgagaacaatcacttccaaacagcagctgaaaacaccccttggttgcctctgagtttgggggtcactgatcaagagggtgacttttctgggacctctgatctcttaatagttgtagttcaacaagagcagttgtggtacattcggcttcaccttcatcgtgggagaatgaccagatgcctacctggttttaaaccacagtcaggggctccggaaactgtccaagaagaaactccggtgccctgaaggcctctgatgagcaacagagttaccttactgactgatggacacagttaattcagctgctaactctcaaattctactgctgactcacaatccggctgcccatcactaggtggcccggaggcctaaggtgaaaaggatgttgtctttctctgggcacattttcagaaagcccatttaaacttcttggtggggcaagagggggcataaaagggggaacaagatcttccacattgcaatattcatgttttaattagcgagtgtccagaacctcatatcaacttgatttgaagggcatgtgtaagaagtatacctacaactccttctctgagccccaaaatggcccccaaaaacgctccgcacagctcctggggttgaagatcctggtgaggtgcagtttgttctcacagccaccgtgcagcccaggtccatgtgcatgattcacacgagaaactaggtgaatagcactcctgggggtgcagaggtatacagggcagaacctggcacacagcaccaggtccacgtgagggggtcctggcgcacacacacgtacacaaacacacacaaaccccacacacataccaaggattccagaattctgggcttaactcagcctagactctaccacattcttcattctgtagttagaggccaaaataaaactcgtgtaaacagattaaataccgtggtaaccaaattcaaaccaaacaccaaggattgggtggggggaggggaaatagtcttactttgaagcatttgggggtgtgggggtggggaagaaaagaggtaaagaggctctaaagattctaagacatcaaagttcttttcctgatttcccagtggaaacaggacagtttcttatactaggtctcccagtggatcaccatccaccatcttggaaggcagcccaactgactgagtcccaaggagacctaacagagatttactttcccaaacaaggaatacttcaataagggtgtatctacagttagagtgcttaattcctttccgagatgttttcctaatggcagcactcctggggagagtcagaagaatgtgtaactggtcaaatcctgaacctgatttgcagtccagcccatgttcacaatgctcgtatctgctgagcctctgacttctgcgaccaatataggccaagtgtgtctggagagataatacatatagccacactccccaccttttcctcaagactagtccagaccacaagctggatgaggtcaaaaactatgtctaatttctcaccattgtatgctcagtgcccaggctggtgcctgacacgcagtaggcagtcagtgaatacagcccaaagagaggtatggccacagtcatcctatttgtgcccccgggacctggtactcaaaaaagaagtaacatatctgatgatggtatacaggcatgcatcaatgccacacactgtgcactgaggggacactgggctggcttcacacccttcaaggactctaagcagtcatgctgggtacccacacatgagcaaggaagggggtgttctgtgtgttttcatagataatgcatttgtctatttgccatccattcatcacatggctaattagttcaactacactttcttattttttgtcatcatttttttttttttttgagacagggtctcactctgtcacccaggctagaatgcagtggtgcgtggtgcaatctcagctcactgcagcctcaacctcttgggttcaatcaacctcagtgttcggagtacctgggactacaggtgctcaccaccatgcctggctaatttttgtattttttgtagagatggggtttcgccatgttgctcaggccggtcttgaactcctgggcttaagccatccacctgccttagcctcccaaagtgctgagatgacagattttctgtattgtagatgctctagcattaggggttttatagacctgggtaaagacatcccctcccagttctagcccgttcttagagatagcaaagggctcaaccaggagcaagcctctcacatgcaaaccaacaaacccagagtctataccccctcagccatcaccatatctaactctcacacaccaagccaattttcccccgccctaaaccaacctggggccaggtagcaggcagctagagacccctctagagcccaaagccctcctgaaattattcaagccggtcaatcccaaactgtttgccctgccttgcctcacctttcctgtgggaaccccagtaaaggttctggcctagattttctccttactcctgtcttctgcctccaaaccaaaaaaccagggcctcctgctgtggccctgcaagcatgctgtgcctcttctttctagggaaactgagtcacactaaactttcaagggcattgacctcactgtgatgtcacccagacatctctatttatttatttggtgggctttatttctatttatttgacctcgctgtgttgtcacccagacacctttatttacttattcatttatttggtgggcttcatttatttgtatttattttttagagacagggtcttgctctatcacccaggccagagtacagtggcacaatcatagctcactacagtctcgacctcctgggctcaagcaatcctccagctttagcctctggagtggctgggaccacaggtgcacaccactatgcctggctatcagacatctttataaattaagacccaggcacaaaacgagacggacccgtggatgagtctccttgtaagcgccttgctttctccgcttcctcccacactccactgggcacccacaggaagccctgacacacataatgagaaatgagcaaaagggcatttctgcaaagggagatgaaaaacaaatcttagaggagtggcgagtgtcctggttaaggctatggagccaggcagcctgggtttgcttgaaggtcacccctgccaccacctcctcactgtgtgtaccagcgcagcccctcaccaccctcaactgccgtttgctcagttatggaacggggaccaggacaacacaagatgctgtgagattaaagcgcatgaatacccaacggggccggcatgtggtgagcactgtgtggacggtaactgcgatgattcctcactctgccttctccaagggaatcagaactgcagaccccccgcagagaaaaacgatcacaccctttattcagcacttcccgcgtgtctgacacacagcacccacagcctggggtataaacaccaaaaaccaccctcacaggggcggaatgatgttcattcccattttgcagaagggaaaactgaggttcagagaggttaagcaggtttcccccaaaacacaaagctggaattggtgcgtgcagccaggatttctgactccaaaaactctcctctcctctccctactttcaatctcccccatttctgatcccctcccctccactgcaacacatatatattgagtgcctactgtatgcgaagagctggtgcaggagttgagaacacagcagtgagcaacactgctggaatccgagtctttatgaatcctacaggcagcaggaaagaggtcattgaggggtaatctcagaaataaatggaggccgggcgcggtggctcacgcctgtaatcccaccactttgggaggccgaggcgggcggattgcctaagctcaggagttcaagaccaccctgggcaacatggtgaaaccccatctccactaaaaaatacaaaaaattagctgggtgtggtggcacgtgactgtagtcccagctactcaggaggctgtggcaggagaaccgcttgagtccgggaggcagaggttgcagtgagctgagatagcaccattgcactccagcttgggctacagagtgagactctgtctcaaaaaaaggaaaaaaaaacccacagaaataaatggagagttcagatggggatgagagctatggaggaaaaggagaagctgctgtggtgagcaggaatacgagattccatttgctgtgcatgcagtgtgtcagacacacgggaagtgttgaataaagggtgtaatcatggaatcaaatggatccctgatcatggatcaagaatcacagacagcttctatggggaagaacattctggaaggaacagcaagcatgaaggtccccaaatgggacaggactggatatgtttgaggaactaccagaaagtcagtatggcagtgacacagtgacaagagaaaagcaggcaatgagaggagagcagaggtcctaccaagctcggccctcccgacaatttgggttggatcactgtttgctgtggcgctgtcctgcactctgtagaataagatgtttagtggcacccctggtctgtacccactaaatgcctatacagctcccgccctgtcctgccaaccaaaaatgtctccagacattgccagataatgcaccccacatcccttccgggataaactgtgagactccacggcgatgctatttcagggacaaaaagaagcctgtgcttatggaacagaaactggccttgccacgacctcattagtggagaggatgggccccactcatttgggggaattatttggggaaaagtataaactccctagctcagcagactgcgagctccccatgaaaggccatgtgtcctggttcctcacacggggcctgagatgcgaaagcacagagggtacctgggagggactgagaaaggaggggactgtggggtccagtgggcacatccctatcacaatcagcctgtgcagctaggaggctgccacgcacatcggcagactctggctttcaaaatgaccctggaggagctgcggctcctgctggcatgtcaatgtcaacagcctttaccctccccagctcctggaatgctagaatttagattctcagttctgcgggagagcaggacagatttacggaattctcagcggctgcctccaccaggggttgccaggggcaagcatctgcaccgtggtgaaacatctctttgaacaaggaagtgagagtgagcatgtgcattaactatcggagatgtgggggagaggaggaagccatgcaaatgagcacggacagccagcagagacgtttaaccttggtgctgctagagtacccacaagtgctaacgaggtggctggtgttgctttaataatcaaataataaccaggcaatggtttagatccattttggacccttcacaattcccaggactacacttaacagtttggtaagactttatggatagcttgcaagtttgaaggcgtaactttgtaagctcagttttgaccctggaggaaggaggtcatgagtaagatagggacaccaaaaagaagtcaggtggtatgctttttccattgactcacagtcatttccaggagaaaagaaaacatcactgtgcaaggctctactgactctcttaatttatcctcacaacagcctcgtatagtaaatattatcctattttacatgggagaaaaatgaagtttagaagcttgggaaatctggtcttcattatttggctactaacccttagtttccatcacaattccctcattctctcagctctagtctagtctggatccttttgcagtcctgccccaggaccttggcacaggttgtttcctgtgcctggattactctgacctcccttcttcacctggttaacgcgacttaaccttcccattcctgcttgctcatctcccagagcctcctctgggctttttccaggccaaactactctaacaaaagctctcttagcatcaagactgctgcttctgcatcaggactcttcaaagttacaatttaacaaagaagccggcgtgtgctagttcaccaccgtaggcatatgcgtcagattcaagatggcttcaaattctttgacatgcctttatcgaaaggtagtgtcttattcccctcctcttgaagccaagatggccttactgactcagctgaccaattgaatgcagtgaaagtgatgttctgggaattctaagcctcaatgataacatacatacctttgcagctcctgctggacctcttagaatatttactctggggaaactccctcttggaacccagccaccatgtggcaagaagcccaagacacacaggatagaccatgtctgatgcagccaacagctccagctgagctccccccaacaaccctcaccaactgccaggcacgtgcatgagacaccttgagcaaccaccacagccaaaccttcagatgatcacagcccactccatatgtgtcagtaacatatgcagaaatccaagaaagaaccatccagccacgtctagtcagcccacaaaaccttgagagatgatactaaagcactgttttagtcattacgttagagaactatttgttacacagcagtagatgatcagaaccctgtaagatccagcataatgaacagttgttcagcttgtacacaccttaggcagcagctaggactagatgcttaataaatatattatttatggattagacaaagaatgtagtgtgtgaaaagattaaggtggaggctggatttatacccgtttatataactccaagttcctcctctcttttctttttaaccatagcctaatgctcccttaaaaacaataaaaccattttatttccagcctatcatatttgatgcaggtttgggaggaagaatacaatattcagacagagccatgtcacaacaaaatggcagctttggttgcttgtcatgcctggaaaaaagttcagagttaaaaaaaaaagtagcttgaggctgggtgtggtagcttacacctataatcctagcacttttggaggctaaggtgggtagactgcttgagcctaggagtttgagaccagcctgggcaatatggcaaaaccctgtctctacaaaaaatacaaaaataagccatccatggtggtgaatgcctgtagtcccagctagttgggagtctgaggtgggaggctcgcttgagacctggacattgaggctgcagagagccatgatggtaccactgcactccagcctgggtgacagagcaagatcctgtctcaaaaaataaataaataaataaaaaggctgttcttatgtcattacactcattgacagcacaggggtctctatgccctctctgcagttatagcatgagcgctgctgtaggcgatatctaaatgaatgggtatagctgtgttccaataaagctttatttacaaaaacaggcagtgggccagattcgcccaaccctagtacacagcataatacagtggtctttcaatttagcagtaagcacgcagtatagggaaaagttaatccacggacctctttttccttctgtaaattgaaagagagggagcctgcttcctttgatttgagtatggaatgaccttggctagttcgtgaagccatccatggtggtgaatgcctgtagtcccagctagtcgggagtctgaggtggaaggctcgcttgagacctggaggttgaggctgcagagagccaggatggtaccactgcgctccagcctgggcgacagagcaagatcctgtctcaaaaacaaaaacaaaaaaagatagactgctcttatgtcattacactcattgacatagctcaggggtctctatgccctctatgcagttatagcatgagctatagacaataggtaaatgaatgggcatagctgtgttccaataaagctttatttacaaaaacaggcagtgggccagattcgcccatccctggtacacagcataatacagtggcctttcaatttagcagtagccacgcagtttgtaaactcaatgaaacaggcaatgcctttgactgaaatgactcttggtactttaattttgcattttagacaacatctttcactgcattttcacatgctgaaatgggttcagatttctaaaatataagaaaaagttacagtaaaacaaaacaaaacaaaaaacacttaatatagggaaaagctaatccatggacctctttttccttctgtaaattgaaagagagggagcctgcttcctttgatttgagtatggaatgaccttggctagttcatgaaggcaggaacattccatgagacaggagttaggaaaccactgggtcactcatagcaaggataatttcccctcactggccctcaaagaactatttgttgataaataatgaatccaaaatctattggaaggagagtaatccactcattactgttagtccattcaatagggctcaatgactgggtgaagtttattcaaagcagcaaaatatcatctaatggcttgctcttttgtctttgtaggatcaagcctttcatcttagaaagtgctacccacgttatccaaaactagcaaaaataatttaattaatgtgtatataagccacaagtgcccaaattatagcttgtgcccaaaccctaggtaatgctagagttatacacataattttttaatttcgtattttcaagaaatgatagaccctataaattatatttttaaatgagccaggaagtaatggctaatgttaattcttaggcaacagaaacgtgctacgctaattattattagcaataatggctcaatgggtaaagaacttctgaactcacaaagcaatttttaaaaactgtattgcattgtttcatacctaaaagagtcccagggttaggtaatttttttcattttataggtgaataaagggagacgcagggtaggtacctgctcatagtcatagctaagtagccaggactcggttgctatccaaggcttcttctatctggaacacttcaagagaacaaggcaactcctctccaaatataattaatatgcaacctctcttcctattattctttgtgaagtttagcactatccaaaaaaatgtactaggctaattattcagatttttttttgcgaagggtgcaaatgttctttctattgaatgtgtgtgcatgtcatttattacaccatatttttaaagggagactaatgcccaataatgaccccagggcttagctttgaagaaaattccaaccaaaaacatcaccttactgtctgaatctgtctccatttcagcaactgaatctttgttgctggactcaataaaacacacttcagatttctaatgcttggatgggagatgagttggtccaagctagatcctcttgtctttgggcccacaccaaacaccaaacacgagtcaaccactcttgcaccaccacaggtatgcatgtattaatatcggcttcccttctgccacagctgtgacttgtgttgggattatttctactccgccagcttgtttaccttattagagtaaccttacagctcaatcattaggactccatggagaagccatggaaaatcaagactcagacatatatttcgatcttaggagaacatgcctgtgctttgtctgtcattattctttttatgggattctaaggcagtctaagataggagaatcactacaaggctcctgaaaaatccctgccaattaaggagtgacagactgcattttccaaagatgaccacagctatatttcctatcccatatgctcttctgcaaggtgactttgccacccccatcccttcaagaggtgggacttatttttcccgtccttagaatctggacaggccctgtgactgctttgagcaacagaatatggcaggagtgatgctgtgccagttttaagtgtagcccttaactttatggcagcttccaccttcctgcctgctggaggccagccaccacatcagaagtgacactaccctgaggccatccagctgtgagacaatcaagccacaggaagatgcttgatgctacctggagagaaacagacagaggggtcaaggaggaacaaagcaccagacagacggacgataaagtcttagaagtggatcctccagccccagtggacaacacatggagccgagacaaacctcccagcagagcccttcctaaggtcctgatccacaaaattaggaacaaaacaaaattaatgttttaagccactcagttttcagatagtttattatggaataccagagaactgttaacatttttttttcaagaccgagtctcactcaatcacccaggccagaatgcagtggtgcaatcttggctcactgcagccttgaactcctgggctgaagcaatgttcccacctaagccttccaagtagttaggtctacgtgtctggctagctttttttttgagacggagtcttgctttgtcacccaggctggagtgcaatggcatgatctccactcaccggaagctctgcctcccgggttcacgccattctcctgcctcagcctcccgagtagctgggactacagatgcccaccaccacacccggctaattttttgtatttttagtagagacggggtttcaccatgatgtctggctaactttttaatctttgtagaggtggggtctcgctctgtcacccaggctggaatgcagtaacatgatcatagatcactacagcctcaacctcctgggatcaagtcatcctcccaccttagcctcctgagtggctgcgactacaggtgtgtgccactatgcccagctaattttttaaaatttttcatagagatgaggttttactatgttgcccaagctggtctcaaacccctggactcaagtgatcctcccactttggtctctcaaagtgctaggattacaggtatgcaccactgtgcctggcccacaaattttactttattatttttttttggagacagagtcttactctgtcacccaggctggagtgcagtagtgcgatcttggctcactgcagcctccgcctcctgggttcaagcgattctcctgtcagcctcccaagtagctggcattaaaggcatgcaacaccacgcctaactaatttttgtatttttagtagagacggggtttcaccatgttggcaaggctggtctagaactcctgacctcctgacttcaggtgatccgcccacctcagcctcccaaagtactgggattacaggtgtgagtcaccatgcctggcctcacagatattttttattgaaacacaagttagatcttccttggggtcactgcaaatagttgtatgatttgtgtaccgcaaagtggcaaataggggctgaaatccaaccagtgctttgctcaccacgccctgcatcggtgagctctggtcttctgctaagaggctgacttttttagccctgcaaagtccccgtacagactagcagtacgtcgaagcacagtcatccaaatgtgggaccttcaataacgatgacttaagaatttgacggaacaatgtgattatcgttgccagaggaggtttttcttccctgctaatatcctggacacctcgctgggcttgccaactttatctggtcccttcttcctctgccccaagattccacccttaaactggagtaggtgctttcactgcccagtggggccgcccttctcggcaggcctccccagcagcgcctgatgtttcatctcatgtgaaattgccccaaaacacaggatcagctctgcactgggccatcactgccactcctcaggggcagctgagtctcctccctgtggccttccaacaatggctggcagtaaggctcattcagaacccattaaggcgattgttttttcctcaagggcacttccttgagggctgaataccaatcagcctgcgatacaaaggaggggccccctgtcatccttgggactgtgcagtggctctgtggggacaatcccacgtgctgtcctccctacaacctcactcccctgggcttttgtgcaggagtcaatattgattactgttatttctttcttttttctcttttttttttgagacagagtctcactctgtcaccaggctggagtgcattggtgcaatctcagtcttagctcactgcaacctctgcctcccaggttcaagcgattctcctgcttcagtctcctgagtggctgggactacaggtgcatgccaccatgcccagctaatttttgtatttttagtagagacggggttttaccatgttggccaggatggtctcgatcccttgacctggtgatctccctgcctcggcctcccaaaggattactgttatttcatgagatgactacaggctcatcatgccacagcagtggtgacccaggagcaattctcatagtataagcaagtcctatagcaaaatccatgggaacctataggaccgtggccaaagtcatctctgcctcccaagaaggggcaggaagtcctattggcctcatctaaccatttatgcctgttcttacaagctctcaatctgtccatccaacccaggagacactcggtcatcatccaccctttacttcttctgaaaagctgatgcaaataacttgggctttaaaacccaaaaagatctgtgtcccaatccagactctgccacttcttagctgtgtgatgttaagtgactgtctaaacttctctacttcctcacctgtcaaatgaaagcaaggacaccttctagcaaacctgagagaactgaacaagataaggccaagtaggctacaaatggcacccacaagttattccattcggttcatgaacaaacctttcattacaaattccaatacttatgtatttatgctgatgtatgagaagacgataggcttcatgaagaccatgattttatggacattatagcttaggttgagctaagtaaaaagtgagtggatgcaaagaaaaatatgaagtaaataaaccatgaccggggagtgttatgtggatgctgtagaaacaccaagaaaataagataggtggacacagccgggtgcggtggctcatgccgtgatcccagcactttgggaggccgaggcaggcggatcacgaggtcaggagttacagaccatcctggtcaacacggtgaaaccccgtctttactaaaaatacaaaaagtagctggctgtagtggtaggtgcctgtaatcccagctactcgggaggctgaggcaggagaattgcttgaacccgggaggcagaggttgcagtcagctgagattgcaccacggcactccagcctgggtgacagagcaagactccatctcaaaaaaaaaaaaaaaaaaaaaagatacgtggacacacaccccgacactgtaccacatggtaggtacagacatcaccaccacctggcacattttaggtgctgaatcagcatctgtttccctctcctgtaacctcctgtggcatcagcctccacccttgaacttggctccagcctcattagggtttggccaagccttagaagttggaggtggactccctgcagtcttggggacggttcccaacaccagggtggtaaggaggaatggtctttagctttgcaggtcatgatttcccttgaagcacctcgtaaacagcagggctggcccacctcaataaaattttactcagcgcttgcaattcccccaacttccttccgtagccagatgctgccctttgctgtgtgcttaactccccactgacaactgatggcatttagatgcattgtagggtgagacccagaaggctgctcattaacatcgtctatatattttaagagccaagaaaccatttttcttggacctaccaattatataggacaccatgcagctcccttccaaatgtcgacccactctagatagttgaggctaaatcaaccaagaaggtgtattagctttcaccagacccatggacaaataattcttcttacacttctaggtagcaatgtaacattttgcttcccagaaaccaaagctcacatttaaacacatggcacccaagcccatatttcaggaaaggccctttgttaattgttcataggaaagtaatccaatagggtctccaacttcctgctgctgttcattccacctgctgctacacctgggcttatttattccaccctgaatggttttctttcccccagcacacagccaggctggttcctgcctccgtgccttgcccaggctgttccctgagtcctgaatgcccttcctgctccttcctgcctaccaaataccttaaatacatccttcaaactcagctcagatggcgctccctccaagaagccacctgtaacttccagaaagttaatgtcccgccaccctgtgccacttcctacctcgtttagcacgtcatgtggtaccatgaccacttccatgtctatacgtgtattttgccacgagatctgttcccaatgttttgtaaggaacaaagtaagtgagcaatgcatgtctggagaatgaataaattcaggaatcccattaatgacagtatctatctgtttaacaaatattcatggagcacatactaagtgctagggactgaggataccacattaaagaagaagaaaggacagattcctgtcctcatggggtttatgttctagatacggggagaaaaagttacatacaaataaacaagattattttagatagtgataaatttatgacaacaataaaacaaggcaatagcattacggccgggcacggtggctcatacctgtaatcccaccactttgggaggccgaggcagatggatcacctgaggtcaggagttcaagaccagcctggccaacatggtgacaccctgactctactaaaaatacaaaaagtagccaggcgtggtggtccagctactcaggaggctgaggcatgagaactgcttgaacccgggaggcagaggttgcagtgagctgagatctcaccactgcactctagcctgggaaaaagtgtgagtgagactccatctcaaaaaataaataaataaacaaaacaaggcaatagcatagagcagagattagcaaactttgaccagtgagtcagatccagtctaccacctgtttctgtaaataaagttttattgacacatagacacgcccactaagttattgcctctgactgcttttgcccaacaatggcagagctgagtaggtttaacagagaccctatggcccataagcctacaatatttcctgtctggccctttacagaaaacattcacagacctctcatatgactaaggagagaggaaaaactttaagtagggtgaaaagggaaggccactgtaaaaagatgacatttgagtgaagaccagaatactaagaaggtgtcagccatgcaaaaatatagggtaaagcatcccagatagaagaaggaacaagtgcaagggccctgaggcaggatagagacagagaaaggagagtgtggcttgggagtaattaggtggtgaatgatacaaaatcaggcatcatggtaggcagagcccatgtgatggggaatctcacaagctgtggaaagggcttcctgctaacactcatgaataattctgaaaggcagcgaaggtatctgggatttgggcagcaagtggtgaaatcgtgtccacggaagagaagggacgatagcaccaccatcatgaatgaggaagtctaaaatgttgacgcttggctcaagacttctttgccaccacgaacaacatctccaagtcaagctctgccttttgttgttgtttggtttttctgagacagagtctggctctgccacctaggctggtgtgcagtggtgcgatctcgcctcacggcagcctcccaggcttaagcaatcttcccacctcagcctcctgagtagctgggactacaagtgtgcaccgccgcacctggctgatttcttattttttgtagagacagaccctcactgtgttctccttgctggtctcaaactcaagtgatcctcccatcttggcctcccaaagcgctgggattacaggcgtgaaccatcactcccagcttcaagttctgcttttcaaatgcgtcaccccacatccccaacacaaggttgcccaaatgtgcacagaagatgcttctacaacagctgaatcagcatccacatgtatcctacccacactcttttttgtatttaaaagactcactgtttcttctcttacattcgtgttttaaaaggaaccattagttcactttaaaatcacaggtttaataagccagctacatacatttcacttaaatacaaaaaggtttttttttttttaaaacgttcacctgtctaccacctcaaatcatctcagccacactctgggaaacaattgtttagagttcaaacctataggaacctcattaatttcaatccacacctaacttctgacagtactaccggagaggcgggggtttggaggacctttttattttttatttttttgagacagcgtctcactctgtcgcccaggctgaagtgcagtggtgtgatttcggctcactgcaacctctgcctcccaggttcaagcgattctcaccctcctgagtagctgggattacaggcacacaccatcacgcacagctagtttttgtatttttactagagccagaggttcgccatgttggccaggctggtcttgaactcctggcctcagatgatctgcccgcctcagcctcccaaagtgctgggattaaaggcatgagccactgcaccaggactggagtagcttttgaccaggacagtgaggacagaggacagcttgagggtgcagcacaagctctggcggcagagcttacacctgaccctgtcactttccagctgtgtgctcttgaccatgttaaatctgagagcctcagactcctgtctataaaatgagccaggctgaggggctgttgagagaattaagagatgcacctgacttggcccaggacctgacccatgctagatgctcaataaatggtcacagctctgattacaaatgcataattatttacagtcataatgatgatcatcaaaagtcctttggtctctccaaaagtgctaaaagcatctcttgtcatcaatgtgtctgagcttttgagacatctgtagccgcagcccactcaccaactgacatccccttgccgccaggggtttcgggaagctttcggccgtgtggtagttttccactgggttcaccaaactaggtctcttttttcttgctttccttttattttttgtttccaaaaggttcctgattaacaatctttcagagagggaggaggaaagaaattacagcaaatgttcctttactctggtccctgctgggctgggaggctgctatttcagactcaatcagctacctgcagggtcaatggatgaaatgcctccccatagggatcaggaggatgcagggccattgggaagcttccacagggacctgtggcctaaaaaccccaactgctcaaaagactcagggacctcaaacctaaaggggatgggagcccaatttctttaagaagcacccgtctttgaaaagcagcatttctcactctacctctgcagggggaaaggagcaacatacatcccctgaaagtaattaccttcaagttgtgaggatcaaacgccatccttaactggagataatccgaaattcactttgaaaccccctctgtccaagcaggcttaagtctctaactgcttaattcaagaaatcattaaaaatggtctttctttccttgccacaaacagagtaaggtaagagaaagacagccaagaaacctgttgaactgctgatgagaaatgcgacagcaataaaatcactggcccaaaataattctgccgcaggttaactcaacggcaagtatgttgctctcacctccaaggatggcgaattcttaagttcttttgttccaatcaccatcttccagaaatggctacattaagttgtagggcctcatgtcaaacaaaagtggcagcgaggatggttacttctgtgtgttaacttgattgggccacggggtgcccaaattaaacatgacttctgggtgcatctgtgaaggtgtttctggacgagattaacatttgaactggtgaactcagtaaagtacatggccctttccaatgtgggtggttatcagccagtagatggagggcccacaaagagggagagaaagaaatttatttttcttgcattactgcgtgagctgagacatccatctcaccttctccagctcagaccgggatttacattattggctcccttgattctcagacccttggcctgggactggatttcatgaccagctttcctgggtctccagcttgcagagagtagctgcagggacttcccaaactccataatcatgggagccaattcccataataattttttttttttttttttttttgagacagagtcttgctcggtcgcccaggctggagtgcagtggtgtgatcttggctcactgcaacctctgcctcccaggttcaagtgattctcctgcctcagccccccaagtagctgggattacaggtgcccaccaccgcgctcagctaatttttgtatttttagtagagactgggtttcaccatgttggccaggctggtcttgaactcctgacctcaagtgatctgcccacttcagcctcccaaagtgctgggattataatacacaggttgagcatccctaacccaatcatctgaaatgctccagaatctagaacgttttgagtaccaccatgatgctcaaatgaaacgctcactggaacattttggatttcagaatttcagattacgggtgctcaaccagtaagtataacacaaaatatcccaaatctgaaaagatccagaatgcacaaagattctggtcccaagcactttggttaagagacactcagcctgtacatggttctgtttccctggagaaccaaactaatacaggtgccttgttcaaaaattataaatttcaagatggcggcagcagaacattaaaccaagtgcaggcccattcctggaggggcccccagtcttgcctgcttccctttccagggtgcctctcatggctcctctccctgtattttcccaacctaaccagaccctatgatctgacaaaggaattctttttttccccaccctaatttgtgaatgtttacatatggtcttccagattcacaatccatgaacccccttgcttgcaaaaaataaaatgacataaaaacagagctaaccagccacctcagggatcctcaaaaccttttagtttgtagaccagaacctgaagcctgagcttcttttaattttcattatctcattctaagagatagtatctaaagtaaactggggctgaacagcactcataacttagctgaaaaaagaaatgtagaatgacccaaaatgtataataaatgcaaaatgagaaaagctaaacatgaaaaagctagtaatttaaaatatgtataagtaaataaaaataaaaccatctccagagcagaggtgggcaagcattttctgtaaagatccaggaatacacatttttggctctgcagcccataaagtctctgtggcagctactcagctctgcagtggaatgctgagtagccacaaaaaacaacacatacacgagtgggcgtggctgtgttccaataaagctttatttatataaacactgagctgactggatgtgtccttcaaggccttattttgctgacctatggcttagagcggcgcttctcaaacttcacgtgcacatctatcgcctgggaatcttgtgaaaatgcaaattctgactcagaaggtcgggagtggggcttgagattctgcattcctaacaagtccccaggggatgctgaggctgcgtgtccaaggaccccactttgagaagcaaaagagcacccccagaaaagaaaagaaggaaaacctactaaagaacccaaatttaagaagcacttagcagaacacagtatagaaaagtaatttattttctcatcaccaaggaacagagttatgcaatttaagtgtatcttcagaaggggaataccatgtcattggtgatcaaggatggagttaactatcattatcagaaagcaaaatgctacaccgtttttaaccaccgctgtgcattttctggtggcagttaacacggacatatagcgatcaatgcaggtaaacgaatccattcgaaggcaggccatggatggtaaatcacgttgtccaataaagttgctaaattagcaacagcgtgacacagagcattttttataaaagcgaatcctttttggaaggagatggactgcaggggtgtgtggctagcaagactggagggtggaagggagaagcagccatggctgcggatccttctggggtctggaagctctgaattttgctgggggatataatgtgaaaccggtgtggaggcttttcctgtgtgttatcaaggccccagtgagggtctgttgcccacaggcagataccaatggttgtatttcacacacagcggtatttaataaacctcttcaccatccagtttataagaagataaaaaaaaaatggctggttccactcaaacactgctggcaggaatgcagaatggcacagccactttggaagacacttcaacgatttcttaaaaagttaaatataaatttgccatgtgacccaggaatcctgctcccaggaatctacccaagagaaatgaaaacatatgtccacacccagacttctatgcaaatgctcatagcagcgttattcacaacagccccaaaagcagaaaaaacccagtgtccatcagccagtgaattagtaaataacatgccgtatatccttacagtggaatactattcagcaatatacgactacacatatagacctcaaaaacatcacgtgatagccagtgcaaaaaccacatactgcatgcttccatttatataaaatatccagaataggcagatctatagagacagcagattagcgggtgcctggaaatggactccgattggcataaggagtcttatcagggttatgaaaatgtcctaaaactagattatggtgttggttgcacagctcagtaagtttactaaaaattattgcatagaacccttgaaatgtgtaaattttacagtatgtaaatcacatctcaataaagttgtttaaaaaaatggttcccattatatctttccctttttcatcgctcacctctctagtccttaaataacatagagatcctgtagactgcaataaacccaaagacacgctggttgttctagaggaggctaaagcaagtcttccgacccaagcagatacgctggagatggcacatcaattgtcttgtcaaaagaggaaaaaaaaacacgcaagggccacgtatttgatttttacagtgaacgatgaattcatctgtggtcagagcatcactcgggcagagacgggcagtgccctcgaagatgcctccaaacccacagcctccaatcccaacccaatcccagcccaggagcttccaaagacctaagccctgaggagaatgggaatcaggagtgacggtaatgatgacaaaggctcagcccatcagctgtgttagaaaaaaaaaggaagagaaaacttgctaagtggagagccaaattcacctcgccccacatgcagccacgcccaaaactcccatgcccacccaacaagccatgtcttttgaaccatgctatcaccccgaaaagtgactcttttgaggtcacactctgatggcagaaaaaactcccatgtgcttggaaggaaatgaaaactctagtgatatacctttggcttgcctccagatggagaaagaaaatcttaagaaatgttgagctattgcaacatcccctttttgggaaaaacaatatttccagcagatgggagaatcataaaaagtaaggaagcacggtcgggaagggttgcctagaatgatccacagtgtctgcagtggccatcttcccccagcccacttcagaatccacaaacacgcatgatggtagcagccagctcagggtcaaagacagaacttggggctagaaactaggacttgggatggcccacaagtgggtccagccatgaccctggtcatctgggtgctgggtagttgagcctaccaggtacagaaggaaccccgccgaggaggctttggggtctgaagaatggaatttgggctccagcgagggacttaacagcatttcctctatagcctcaaaggtatttgaatcaggaacactagcttcacagccagaggcctgataatctccttctcccctttcattgaaaaagaaaatatctaagatactggagaatacagtaaaatccttaactctgttcccccacccccgcttttttttccttcattcctagcggcaaggctggataagcttatcaagagcaggcaaactacatcttagctctgatcctttcgagaaatccatttggcgcctttaacgtttcatttggcagattgaatttcgggcatgtatttatgggactgggtttgcccttaatagagtattgcataaatcccattacagtatccacttcagtgtgtttggggttttctaagccagggctttatctaagtggacagcatgggaatgacccactctggctcagaaactcccgcctctgccctggaaccaacctttgcagattgcctccatcatcatcaatgtcaaatgatgttttgggaaaagttctgggaagggtcagaatgaagcatgtcccatccacaaagaaggtggtgacaagcgtgtcatcacctgctagtaaattacaggatttccttccaggaaccacctcgctccacatccctcttccttctggcaacagccagagaaagtctgttatccacacaatgcctttctgtctttcgtaagtatgcaatgatgaagatgcattacttgtcatttctgaaaacaaaacaattattaagaaaagtgagctataaacaaaacagatcaggcttagcaaccctgaataagccagttctctgtaaccctcaagttaatcatttaaaaaaacaatggggccaggcacaatggctcatgcctgtaatcccaaaacttggggaggccaaggcagaaggatcacttgaggccaggagttcgagaccagcctgggtaacatagcaagaccccatttctacaaaaataatactgataattacaaaattagccaggtgtggtagcacacatctgtagccccagctacttgggaggctgatgtgggagggtctcttcagttcaggagttcagggctatagtgagctatgactgcaccactgcactctagcttgggcaacagagcgagaccctgtctctaagaaaaaaaaaaaaagaagaagaagaagaatggaattagcaatcccaacaacacaggtgtggagttttaatgcagatgaaagaagaaagcatgcttagctcacaggaggtgctcagtgacgcttggcccatgcactcatggcacacaccttagttcatctttcctagctggctctttcttggcagggctggacaggccacttacttcccaggcaacaaggcagagatgcctgtaagatgccttctgcgtacatggttcaggtccggcgtggcacgcaccatatgcaagagtcaggggttacaccaggctgaagtgtcagtacattaagaaccatttccttcctcctgggatctgtcctggaagcacgcacagaactctccattcactgacttttcacataaatagactccaaagcagaaatgcatggaaaggggctgacagcgggcctcagagccccacataaagctaaaggaaagccatttggccttctggaaccttcttttaccaaggcacactgtcccctcaccccctacaagaacccagcaatccattatctggtcactttcttctacgacacaagcaagtttttaaaaaaggcaacggcagctgcagtaaacgaagaagtgtacgtgatgagggccctttgggctatttcaggctctgtccctgcctgaaggtggctgtgggtttggttacatctaagttgggcctcagagcttgtgaaggtaaatgcttcctgatgagaaggaaaaaaaaaagtctaaggagtcttcattgattcaaccgacatctacaaagttcctactatgtgccaggctccagcaggtggccaaagggaacctggtatactaaagacctggtgccctctctccagggctgaatcctccaaggattctctcattgactttattttcatcttacatcacccgtgagcagctggggtagatgttgtgcagttactgaagaatttgtatgtactataggaggcatgaagaatgcatgactttatttacttccaactaaaggcaggaagtagtagtaatgtctccactgatatggtttggctgtgtccccacccaaatctcaccttgaattgtaataatccccacatgccaagggcggggccaggtggagataactgaatcatgggggccgtttcccccatcctgttctcatggtagggaataagtctcatgagatctgatggtttaataaatgggagttcccctgcacatgctctcttacctgccatcaagtaagacatgactttgctcctcgttcgccttctgccatgattgtgcggcctccccagccatgttagaacttcgagtcaattaaatctctttcctttataaattactcagtctcgggtatgtctttattagcagtgtgagaaaagacaattacacggtctaagagatgagcatgtcaaggcccagagagatgaagtgacttgcccaaggtcatacagacaggaaggggtaaagggatttgaaccaaggctgtctggctccagagtccccactcattgccatgatatcgccttgctttcaggagtttgctgtggtctgatctcagcactaccaccgtggctggcacatagtaggggcgtggatggcacatagtatgggcccaggcagcattggtgaaactgaatttgatcatcttatttaaagctactgcaatcacattcagcttttaagctacgggttgggaacgaggtcattctataaaaatggaaagcagaaatttaccctgaggaattttttagagttagggatagaagtccaaaagggaatctacttcaaatgaccagagagctaagacatgacctcaatacaatatgattaaatgagatgcagtggagaattacataacagttcagaaacacaatttacatctccactggtgctttcctttttattaaactagcatttctgttacgctgacaatacagaagagcaaggtcttctggaactgtttggcttacacaggcgtgagagaagtgaagacttattccattcactgggtaacatatgggtttcccagagagaaagtccacacagccatgcatgtgaaatgggtgatgataacaatagtaattgctgaccctcttgagtccttcctgggggccagacctgtgcgaaatgatccacctgcattagctcattgaatcctcatgagaaccttctgtggcaggtaaacagtatgggtcccattttacagatccgaaaactgagtgaagccgagctctaaactcaggccatctgtctgaggctctcagtccttagactacatttggaacactttactcaaagaacaccaattatgataaggaaaaaagaaaaaaaacgatgcttgccaaaatccagacatctcagacatgaaggcaagagatccggaaccatctgggcccgtgtagggtacaagctgccggcttcccactttaataccattcccttgggctaaactcccacatgtggccacagaaacccacttttcaaacccggcatcctccgcctccaatcgtatttggctccacagaagccaagaaggcatttggggacaagcaatctttatctgtaccaaatgtttattggagccactccaggaaatggtcccacgtgaagccaatgtgcacgatgtcacccacatctgcttggaatgcacttgtatctacattgcaatgctcagagttacatgtctcttgaaacgccaccctgcacagctatcacctggtccaacaagaataacagcctactgttcgtggagcggttgtttagataaagagaagagagggaaggaggaatcagatcgctccttcaaaatacctctccccatgcaccaattacagaaaattgttctgggaggcaggaggagctctccaaagtgtttaggaacacaaatctggcaagtttaaaaaatacagtgaagttcactttcctgaactccagcatcatgtcctcaaagctaaatcatactgagcagtatttgcagcaaagaggctgaatactggttgccgcacggtgcagtcagcctttctggacgggatcatacatacttaccaacagaattcttgaggtttgcagaggaaccaaaattacaaactatcagaagaagaaaaaccctcacatcaaatgcgaatggaacattcaggaagagagaaaggattaaagaaatggaaaagacgaaaacctttcccactgggtagaaggaaggagcactggtttccaaaaccactaaggggcccttaatggccagagagggagaatatttaaaaaggtctgcaattctagaatttccccacagatgagatcaggcatctgtgagacgaacctaatcgcagaggaaaacaggaagaagatgatgatgttaatagcgctctcccctaactttggtttggtggctgacccaacccatagcatttttatagccattatttcattcaatatggtaattgtgaaggtaagagatagcatgaatgaccactactcttgtacttcaccaaaaaagcctattgtatgggacactgatgtcctcattggggcaactatggccaaggtaaatgttaagtggaggccagattaaacatacgctacgtaagagtggaggactgtcagatacttgactatatgtaaggtagacactgatagcatgggtgcctgaatcagactaccagcgttcacatctgtatcagttcattcccgcatccctagaaagaacaacttgagactggataatttatgaagaaaagagatttaattgactcagttccacaggctgtacaggacgcatggctaggaggcttcagaagacttacaatcatggcagaaggtgaaggggaagcaagcatatggtggcaggagagagagagtgaagggggaggtgctacacacttcgaaaccatcagatctcatgagaactcactcattatcacgagaacagtaaggggaaagtccgcccccatgatccaatcacctcccaccaggcccctccctcaacactgggaattacaattcaacatgagatttgggtggggacacagagccaaaccatatcagcatccaagctcaacagctcacttactaggtgatcttgtatgagtcagtacacctccatgtctgttttctcatttataaattagatctgatcattgaaattaaagagttgtcataaggatgagtgcaatacagaaatattggtaaattctggtaaatacagaaatttaagctgttatcaaatcattgtcatcatcatagtggctaaaagttagtgaagcaatgatttagatcaagtatggcaggcacatggcatacgtggcacaatttcttcctcctgcatccatggtggacatggctagttgattgcagaactttgcctttaaactcagatgcagcctcagaattggtcacacagagttccagttatccccaaacaaagttgacggacagatgggtgaaagattttttgctaccctctagaacctcatcagaaaccagataaaaccagccgctcccagagaaacagtcacttcttgttggatagtggaaaagagcggctccctaaattacagtcatccttccaaagaccgacataattttgccatatctgcatgtattgtgtgctattatttatgcaatgtttatttgaatatatttaaaagagaaacttatacctgcatcccaaatgaaaaatgagttgacacaagccctaaacagaagataatgtgaaaagaaagaaaagaaaggaggaatggtactgttgtaatccggctagaaaacactgtagtagtaggttctgaatgtctgctttccattgttaaaaagggaaactgacaagttttagaaaggtgataaagatgtgctaacaacaaaccgagacttcctctttgactcaaccacttcctataagattcaatgtcatttaaattgtgccaaggtacctgtagtaggcagctcctaagatggccccaaggatacccactccagtatccccactcccacccaaatccatccggaatgtgagccagatttagtcactcacttctaataaacagaaaaaatacagaagtgatggtattccacattcaaggtttggttctaaaaagactgcagcgtattaggtgcatcttaggtgctgtctctcccatattctctcttagatccttggcttttggggaatccaactgtcatgttgtgagcttccctatggttaggacctgtaagaggcttccagctaacagccagcaaggaaggaactggggcccttggtgcaacagcccatgcaaaactgaggccagctaacaactacgtaagtgaatttggaagcaaatcctccccagtagaactttcagatgagaccaaagatctggccgtcaacatgaatgcagaatgaactgataaccttcataacattttctaattaacacatattcattgagaaagcaaagattcaagagatgcactgaaccagagcacgctgcttgctcacccatacaggcaaacaataagtggtaagtatcagaatgacttcctggatgagaattttcatgtacacatacacacataattacagtcagcacaactgcattcaatgtcagccatttctatcagctctttctcgttctttgatcttaattacatgaacaagtagcagaccatgagccttagaggcctgtggacctgagttccagtgccccctctgcccctaatgaactgtgtggccttgaaatagaaatggaatcttatccgttcatctgcagaatctggatactaagttccacttcacatgtcaatgaaaggaatagatgcatttgtatttgaatgtgattagcatggtttatggttgcctaaataaaatataagcttcctagtgtaatattctccatggactactgctctctgctacgatctataataacccaggctggagaagtccagtaggggtaagtttcacactttgggtcaggggagtcagcactgcatagaaatctaaagcaaaggtggctgaacgagaaaagctaagttccaacacttactaatggcgtggctgtgagcatggtaccgaccctcatctgtaaaacgggcataaccagtgcctacctatgttctgatggctgaatgagataatatagttaaggactcagagtagtgccaggcacacaataaaacaaacaaatgttacatattttgtcaaaattatcattaatttttttgagatgtattcttgctttgtcacccaggctggagtgcctcagctcatgcctccgcactccagcctgggcgacagaacgcctcccaggttcaagcgattctcctgcctcagcctctcgagtagctgggacgacaggaaaaattatcatttattgttattatcactatcataatttaattcataagtggttatatagagacctttatgataaatccagctcactgaaatgttttgtttggccacacagggtgttactgaaaaaaacacaaaactgaattagttgttaatatttattaaatattgcactaaaaaaaaggaaatttccggttgcttttaatacctgaaagaatggataaccctgggcctgattctcttacagtcacaggcagtggagccaagaagcaacagtccactgcctctgctcttctgtccaccaaagtcctcaccattccctatcgccctgcacctgtcctagagtaccaacttacttctcctggcctcaagggaattgggactttggactcttgttttaattccttaaagtcctgccttaaatttcaaattcttggatgatttttttaaatagcaggtactctaagtagcaatcgcaagaacagatcttgaataagattaagtctccctcaggaaatcctcagcaacactaagtgtcagataatggctgaggataaagataggatcattatcaaaaggaggataaagatccagctctctacaataaccctccacacgtgacccaaaaatgagcttccagagcttaaacgtcaaagcgttaaagttatttttgccatccccttctgtgatggttaatttaatgtatcaacttgatgtggccacagagtacccagatagtcagtcagacattcttctggggtgtctttgaggatatttctggttgagattaacatttgcactggtggctgatccacccccatgtatggtgagctcctctgcctggcttcttgagctgggaaacctgtcttttcctgcctttgagttcagatgaaaacattggcccttcccagatcttgagactgctggttttcagactggaacaacactctggccctcctgggacccagcttgccaccgcaggccttgggacttctcagccatcatacttgtatgagccaattccttataatgaaactgtatgcgtgtgtctcatatacatcccattggttgtttctctggagaaccctgactaaaaaagctgttatcaaattgatagtgcagagcttacaactcattgcagatcagaatcaaaagtgttaaagtgatttttgcccacctaccccccacctccatgatggttaattttaggtgtcaacttgactgggttatggggtgcccagatatttggtcattcttctggggtgtctgtgagggcggttctgaatgagattaacaccacatattgccccacatatttaagttgaggagcctcaactctctgcagacttatcactgccacaggctgcctggagcatttttagaccctggaggttccacagctctggattctcaatgagcccatggattcccccaccttgagagagggggcaaggaccaccccaggggatgctgggaagaactgcagagcatcctccaataagcctttgcagctctcttccctcttccccatctcctgagcccagctttctgcatcctcattcttttggaggaaagacaaaaacaagatcgccttattcctactcaaattagcaacttcatggcttaaccttcctccaaaactaaactgagagtggcaatataggggatttggattttcttcttcacatattcatctcctaaatgtttctcggtgaacgtgtgttactttaatcagcaaagatgatacaaattattgattcattctgcattcactctatgagaggcagagttagctcagcatttgaggactggacgcattggagcagaccgcttgggtgcaaatctcgactcaactctgtgacctcaggcaagggtcttaaatgcttttgtaaaataagtatgaaaattgtagttacctcacagggtggcagagattaaaagttaattgaagcaaaggaattggcatgtgcctgacaaatagtaaatgctcagtaagtacttgctacctatattatcatcattttatagtatgtatatatagtatgatataaaatataaacatacatgatatagtatctgatatggtttggctctgtgtccccacccaaatctcatctcgaactgtaatccccgtgtcgagggagggacctggtgggaagtgattggatcatgggagtgatttcccccatgctgttctcatgatagtgagcgagttctcacgagatctgatggtttaaaactgacagtttcccctgcattgtctctctctccagccaccatgtaagatgtgcctgccttcctctttgccttccaccatgattgtaagtttcctgaggcctctccagctatgcggaactgtgagtcaattaaacctcttttgtttataaattatccagcctcaggtggtacctttatagaagtgtgagaatggactaatacagcatatattaagttcctgctacatgacaggcattagaaacgtagtgatacaactaatcacctaaccccatgggtcttaacctatctagcaggagtgggacattatataaatacacacctctttctgttccaggatccaatccaaactgctttgcactttgtcatcatatctagactagagggttttctttttgaaagctcaaagctgatccttttcctgctttgagctcccaatacttttccatgacactctcaataaaatccaaactccttgctttggtctcaatctcaaagctccccatattttcacccactgacccctcttcctttcccccaccaggctcccctcactcaatgaccaccaggcacactggccgttcatcaactctttgaatcccaagcttcctccagccttcacattttctgtgcctcctggctggaaatctgtttcctcagaggtcctcataatgtttcctcttcatgtttaggtgtaagtgcgaatatcacctcctcaaggaggccttccctggtcatcccagccaaacaagtctcagcccaccatagtcaccgtctaatacacagtggtttttagaagaccactaattgctaaactaatcctatttatatgtttataatttacagtctaaccctcagtactggagtatagggaccttttctatcttgttcactactttttttgtctttttgagacaggttctcactctgtcacccaggttgcaatggtgatcacagctcactgtaacctcaaactcctgggcttcagtgatcttcctgcctcaacctcccaagaagttgggactacagacacatgccaccatgtccagctaacttcttcttcttttttttttttttaatagagacagagtctcactatgttgcccaggctggtctggaattcctggtctcaagtgatcctcccgccttggcctccaaagtgctgggactacaggcacaagacaccatgcccagctcaccattttattgtaggtgcctaggagagcatgctgcacatagtagatgctcaataaatatttgttaaaataaatactattggaaggaatgaatggatgaaggacaggcatatattttcaaatgttcacagatgtgtcgcaagaacctagtgcagtgcctggcacatagtaggtgctcaatgagtacttgtcaaaatacagactgagggaatgaatggataaagggcagacatgcactttcaaatgttcattgatgtgtccctagaacctagctatggcacctggagcatagtaggtgctcactaaatatttggtaaaataaaaatgggttagaagagtgaatggatgaagggaggacaccatttgtttttttagacagggtctcactctatcacccagactgaagtgcagtagcacgatctcagctcactacaacctttgcctccagggctcaaacaatcctctcacctcatcctcccaagtagctaggaccacaggcaccaacatgccaggctaattgtttgatttttggaaagacagggtttcactatgttacccaggctggtctcaaggagcctgagcttaagagatcttcctgcctcagcctcccaaagtgctgggattacaggcatcagccacacttgttcactgatacgtcccaagaacctagcccagtgcctggcacgtagaggctgctccataaatattaatatttgtcagatgaatggcatttgagtgagcaccatccattgttaaagaaagaggtgaccacatagagtgagtcggctggaggccactcttctgcccaagggcctctctcaagaagtcaccagaaaggaaggctgggagcccttcctggcagctgccagaacatctgtctagagaggccccgggctcacctgggctgcgtggaggcctgggctgggctcttttgagcgactctcactactggctcaggaagttccacccagtgccgccccagcatggaggctcctctgtggcctcaatgcaaactcgcctcagaaaaggcagctgattaacacgcgtggagggtctattgtctgaatcccgtcaccagcggagaaacagctgtttatagtttgtttattcctctccctttggagcccacgggaggaaacacaagcgcttgttctcaggggcaccattcagcagctgaagtgagtgaagaaaacggtgtttatttttaatgggataaagagggggaactcttacaaagtttggacactagcagggagaccgctcttcaggaggcaccaggccttgtggtgatgtgttgcaccctgcctctcgagggatgctcaagagtctattccaactcccagctggaaactcaggctcgggccacggtggtcggtcaaacagtagacttgggtgagcacctatagatatgagagatctagaaaagctcgtcaggcttgaaaatgagagagcaagatttctttggagagcaaccacctgctatttaatataggtgacatcctataaagggctgccaagcccagttgtgcaggctgggcactgcacaaaggtgtccagctgagggagaaatccagcctctgtgagctgctcatcaagccatgctccacagtttcaaaaataaatacatacataaataaagatgactaagtgagacaacagcagtctcacagatatatagatgtatttatgtacttcatctttaaatgctcacttattgactcttcacaataacctttcagattagggaccactgtcatcctcactttacagatggcacactgaggcagagagagggaacctgactgctccaagctcatccaattaggaaggagtgaatccaggattcaaacccaggctcttggtttccatcaacaggtgatgctgcctcttctaggaaaaaaaaatggctcaacaagccccagagtgtcatattcagaaaacacagtgcccctcccagtcttgggagtgagacctgctttcagaaacacccatgtcttccctcgattctgcaggtgatcaggctggaaggaggtaggcgaagaccccatcgtctgcattacaaggaactccttctaaagactcaaaagatttgctctgaactggtgaaagtctggggactcccactcagcctggagactcaaccaaccctcagcggggaacagcccaacccaaccagagctgaggccacccgctgctcccttctcagggcccagggtcagccaaggccattttcaagtgcgggggactgcagccaaactcgctgaaccagacccaggggagcccaagagggacctctggactcaagggaagaggacgctctcatccctgtctactctcccacccaccccctcctcccctccatccctccctccttcggagagcctccacattcgaatctccgaaaatggttttcacaactcagttagcagcaatcaattattcacgacctcgcttccccaccaactcatagactgtcactgttagcaagataatttctggactctgcccaacagccctgctctaaaccaagcggcctgctatttatttcctctcttccctaagaccctcccaatgcccaccaaccactatcactctcaacacaggacagagagacagatgggaagtcccctgggtgcctgtagcctgggagggacctgacagccaggggctgctcccagcccacgtgatacatttcaggcttggggcagaatgtctgaccttagtttaatccaactggaaaacaggactcaagcattctagaccctgtgccaggctctgggacaaatcccacattattttataaaacgctttaagctccgaaaacattgtgtcctgcacaaagcatgacttgggagggtctcccagacatgccgtcctgctgctgagttcatgggtcaaagacatttggaacttggcaggggctcatattttaagactaccactagcatttccatcctagaagcttgaagctgtctttaggaacatattcctacatcccagggagaaggagagaggtgcttatgggatgctcttggaaaaagagtttcagcctatgtcgtaagacccatggagggtggttggatagcagctctgctgtgtgaacaagcgaccttccacgaaagccacttttcaccctctaagcctcaatgtccacatttgtaaaatgggagaatatgagtactacttctggggctgcagtaagagttttaaaaaatgaggcatttaaaaaacacccagtaccttgcttggcacattgtggacattgtggcctctgtgcttcattgtaagaccctgtcgcttgtgacatgcatcattgattgaataacaatttggggcaaaagggtgtgtgctgaaacattaaggaaacatacacatcaattgtaaaattcatcccagatttcagaaaggctatttactaaatattaaaaatgtgtatctttggccagatgtggtggctcacacctgtaatcccaccactctgggaggccaaggcgggtggatcacttgaggtcaggagttcaagaccagcctggccaacatagtgaaaccccatctctactaaaaatacaaaaattagccaggcgtgatggcacatgcctaaaatcccagctacttgggaggctgaggcagaattgcttgaacccgggaggcggaggttgcagtgagccgagattgcgccactgcactccagcctgggcgcagacagagcaagactctgtctcaaaaataaaataaaataaaatggctgtgagcctgggcgacacagtaaaaaatgtgcatcttaaaatgaagcatattatcattattatcattattacaattgctgtattcattttaggtgggaaaatgcatacagagaagctatgtgactgaccgcaggccacacagccagcaacacaatctagtccccacacagctccagaggaaggagggagaggaagaggcagagttgaccaggcaaatctccctcatccaattcctcctcctcctacaagaatcaacagtaataataataatggaagatgagggtgaggggaggtggaggggggaggaggaagaggggggaggaggaagagggggaaggggaggagggtggaggaggaggagggcagaggaagaggaagaggaggaggaagcagcagcagcagcatgttatggtgcttaatacaggcccagacactgtgctaaatgaggtgcatgtattaactcatttatttctcctgacaaccctttgaagtgggttcatcatcatccccattttacagatgaaggagctgaggcacaaagacttcagtcacacagctgctgggtggcagagccaggctgcgaactccggcaccttggcgccaagtccccgtgcttctctactgcattgcacttcattccaccaactgagacaaagagggacgttttggtggagaaggaagtggcatataagtgtcatgccatgcctggtctcacccacacgcccaaggaagttcctctgaacccacagagcatgccctgggctccctctgatgaaagcaagttcatgcctctcttccactctctcctgctgccccaggccagctgagcaggccaaaggagggctggggccaaatctgcagccccatcctggggaaaggctctgacgacagtagccagcttctcactgctgtctgcaggatctcagcaattccacgggcatggagaacagcagcccctggagagggtaggagaagattgggtgtctgccaggcctgcagctgtggacacttcccctatgggctgcggggacggggcaggcccagcacctggaagagggcgcctcccctgtctggctggtcttcagtcccatcaacgggacttagcatcaagtgacgtggtggttatgcacacgggcttgtggggagctgtgcaaccttgcgagagttacttcccctctctgtgcctcacttcctctgtccataaaacagtgactctgacaatgctgacaacactaggtgttggaagcattaaatataaaacgcctaacatgtagtatgtgcttaataaatggtagctgctaattactattatttatcatcatcaacaggactatgcatcaactactaagaacacaggtggaccttaaggtgccatcagtatgggtgaggagctgacaagaacccatggaacaaggcatgattccttgttctagaatatctttggcctttggatcttaaaatgtcatcttaaagtggggttccatagctctcacttttaagacatctcatctgatctttcaggcaatttctgaaggaaacaaaaatatttactgagcacctattgtgtgccattcactgtttccaccactgggaataacctgatggagttaatgaatccaagaccagctatgatggtgatggcagttactaataaaaggtgagaaggaccgggagtggtggctcacacctgtaatccagcactttgggaggtggaggcaggcagatcacttgaggtcaggagttcaagaccagcctggccaacatggtgaaaccccacctctactaaaaatacaaaaattagccaggcatggtggcaggcgcctgtaatcccagctactcaggaggctgaggcaggagaatcgcttgaacccaggaggcagaggttgcagtgagctgagattgcgccactgcactccaatctgggcaacagagcgagactccgtctcaaaacaaacaaacaaacaaacaaacaaaaaaaaaaaggtgagaaggattctagagtttattgttaggtagaagtgggaggtactgggaggaaaggactcttttctgcagacaatcacaccaaaacagccacgtacacatggaagtgggaaaggacacgtgggtcacacacacggctggaagaagagacatgtgcaatcagggcacaggtaaccacaagagacctaaaagttcagagcacaagggacccagaatccctcagaccattttaaagacggggaaacagagaacctgaaaggcaggcagcccaaagccacaccaagcaagacacagaacaggttctggaatccaggtatcctgactcctgaaagtcgagatcactttgtcttgcgtcgtaaacagactaagacattccagcacagcacagcccgccatcacagacagacactgctgccaggtcaggcagcccccatctgccatctctctagatcagtgttaccaagctgaggggagtgtaagacaccaccaccctcaaaatcaaacaccttaggacaggaccaaagacaggtaagttttgacatggagatgagggagagaagttccgagttggggacatcatcattctgcaggggcaggtggggaatcgaaaaagccgttgcatgcaaaggacaaatgttctttcattggaggtggagtgataataactgcagagggactctgggaaggttgttggacagagtgatttttgtcttcaaagaacgtgatcaactttttgcaagtgttcaagttccacctccaaatcttgcaatttctaaaccagtcaacttttctaggtttttaataaaacagagatgatgaacccattagcagggctgttgggaacctcaccccagaaaacagttgatggtggcctggaagcccctgcaggctcttgttcctgtccttcttcccaaatgactttcatgtccttgtcataatgaccacattgtttacctcctctccccgcaatccatgccggactatcttctctttgtttcatcttaaatgtcaccttgttggaaaagccttcccagatgaccctccccttctccctgactcactgtcccctccatcggaacctgagctgcaggaagtcagggaacgcgttctgtccactgctccaaccccagctcccgtgcagtgactggcacctagtaggctcttggtaaaatctgttgagtgaatgaataagtgtctgcaaacatcctgggtacatctgtaaagcatgcactcatagaaaacttctactatgtgacacacagtagattatcaatggctgttgctgagaggacatcaaagtcaattccaaaccaacaaggtcggcttcccatttccgctgtggagtagccttgagcttagtgagatagaagactcttgcccatcaccccagggacctgctccccagagctcaaggcactcagtaatgaggaaaaccctggctttacaagacacagtaaggcatgaaaactggggagaaagttcactgggaacctgcaggacactacaggtattctacaaaatgataagctactctgccattcttaactattcttaaaaatgagaggaaattgatcagcagaaaaaaggtacatgaagtgtgctgtgttttgatgtgggcaggctaagtgataacttcccctaacccgcccatcctaataacatgaaaccagtggtgcctcctgctactgacaggttcccttactcaattgctataagagaagcattgagcaagcattgagaattaaggaacctacagcctattcatagattctaaccctaagaggaacgaaattagcactttgtatggttgggtcattaaaggatctcatgaattaatactatcgtgtttgcattctgttttgtgaatttctgcctttatttttcttaatgtccctttcctactttcttttgtttgattctcagtttttttctttttttttttttttttgttagtaacagggtctcaggcctggcaccatggctcacacctataatcccaaaactttgagaggccaaggcaggagggtggcttcagaccaaggagttcgagaccatcccagcctcaattatttttttaatggacttttattttaattattttactctttcatatttaatgtcaaaacctaaagtgcttttaaaatagactaccagttttcctctgggcacagttttaaccttatctcaagttttgatatgaagtattttcattttcgctaatcaatatataatctgaaatgtcaaatttaatctattcattgatctaagaattacttagaagagtttcgattgtttaaatttctatgcgattgtcttttagaggctaattttcaatatatcttattgttttatgaaggaagcctggaagttttctacttttgaaatctattaagattctttttagaccaagttaattatcagttgtaattagcacgttagaacatctagaaagtagtctttaaaaagagaagttcttcccctagaatacacacacacacacatacacacacacacctttgtaaagagtttcaatgaatacttacaattctagtcttaccttaacaaaagtaaatattccaacagaaaaagacaacctattaagctaaagggaaaggaggcaaactaccagaatttaagggttaagtttctcacatctgggaattccactctggaatcataaccacaatagcattgcagctttgcagccctattttaaagacgaaaactgaggcttccagatcctgagtcacatagaaaggattttagctgagcccaagggtttcaagtccacaaatcctttctgcactaaattcaaatttcattccaaaagtaatactaaaacagcagctgaccttcttctcttgtgccattccttaagtttgttcatcgcaccaggcagaatcagaagacaggctcctacaacagctagggctttactcctggtaaagtgggttggcttaggagaagaacggacaggactctttgacaagccccagaaagaatattaagtcatttttcagccagcaccaagcaaacctgaaagatgggtggatcctagggtatcctaattttactcttccaaccctgtcagtgctagtgtccaaaaagtggagcagcaaatgggaagtgactggcattcagaaactgacacaggatcctgcatttctaaacaatgctgacaacgcacactgaggcagcacctccggggaagtctccgtgctccgatgctgtggccatgtacagcatatgcagtccccaaagggatatttcagcacagagtttcaatgtaaaatgacacacgctactgcaggctagagatcttattggggacacagggctatattcatctgcttcccagcaagaaaaccagaaagccagagataaacagaagtcaatcaaagcagaaagtgacatctagaaaaaaaacacctaattctgccaaacctgttttgctgaataaagataagagcgctgtggacaatatggctttggtataagaaattaaatgatggcaccattcccaaaagcaactaaagcagttgacatcgggcttgttcccaacagcctagaagggactaagaatggaagaacaatggacaattaagaaactgtttctacggactctgaattttgcaagactaattatgaaaataagccttgttacagagtttcagcatttgaaagtattactgtgctttacttcctactctgaaaggtaagacttccaaattaaaatataattgtcaaatcaattggtaaaaaaaaagtagttaaattaattccgctcctaggtatatactcaacagaaatgtttgcatatgtttgccgaaagagatgtccaagaatgttcacagcagcactatttataatggccccaaactgggaacttcccaaatgcccataaacagaatggatatgtaaattgtggtatattccacaatgaaataatgcaaatgaacaattacaactctgtgaaccaatatagacatagggttagcaaactttttggtaacaggccagatagtaaatgttttaggcttagggcccatacagtctttgttgcaactactcaattgtgctgtcatagcacaaaagcggccatagctgatatataaatgaaatggacatggctgtgttccaataaagctttatttatgatcgcaattttttttttttttttgagatacagtgttactctgtcatccaggctgaagtacagtggcacaatcttggctcagtgcaatctctgcctcccgggttcaagtgattctcctgcctcagccacctgagtagctgggattacaggcatcaaccaccacacccagctatttttttgtaccttttagtagagatggggtttcaaccatgttggtcaggctggtagcaaacttctggccccaagtgacccacccacctcggccccacaaagtgctgggattacaggcatgagccaccatgcccagtcaatttgtggacacaaatttgaatttcatataattttcacgcgtcacaaaatatcattctttcctcccccccccgcccccccccgcaactatttaaaaacataaaatccatccttagctcacaggccatatgaaaacaggcaaaggaccagatttggcttgtaagctggggttcgccaaccctggacagagataaaactcccagacgcaatgttaaccaaaacaaaccaggcacaaaagagtacagactgtatgattccatttctaaaaagaggcaaaagtacctggtggggttagaagtcacgatagagaccctatccttgcaggcatggggtcagagtggacgtggccgggatcccgggggctggtgggctctgaattcgggtgctggttagttgggcgtgatccctttctggagctgtttattcatgatttctgcattctttctcatgcatgttctacttcaagagaagtttagcaagtttttataataaagtagcttacaattcaatcagcttcaaaaacagaagtataaagagaacgagagcaatcaaattaaattagttatgacttcttcatgatggccaggtacctgccaatgctagagtacttaagaatatttaataataatggctgggcacagcagctcacacctgtaatcccagcactctgggaggcctaggtgggcgaatcacttgaggtcagaagtccgagaccagcctaggcaacagtgagactccatctctaaataaataaataaataaataaataaataaataaataaataaaaggtagatttaaattgttttcctctattattgtgtttacttccagggtggagtttgtttcatggtttaagggatggtgctaccatcagaatccggccaggctattttctgcggcgtctgcgcataaagatgatgttcacccaattaccagcgactcctcgcatggaaatctaccatcaatactattaacataaacagcatctggcaaaatacatggccttcaacctacagcaaaacctgcgctggactctcacaaaggaaaaaggccaggtctggcttccatttgatttccagagaatacgcaattaattattttttctcaccgtcagcagctgagtctcagtgaaatccgtgcttgtaattatcgctgtaattattattttaatacaaatcagcaacttatcaaaatattacgtgtcaggtgctacctctctgctgcaagactatggatggaaggtggaggccgtcaccccagcttcactctgtgcacacagaggatgggaatcagggtgagggtacttctaccagagccagactttcagcttcctagatgtccacgtccacagtcagtttcacactcgaccttttttttacaggcaataagtcactctgtacattctatgtggtggtttgatcttgggcaattcagttcactcactgctaggtctcagtggtaccatctttgcagcaggcaaacagtacaaaccttttttttttttttttttttttggagacaggatcttgctcggtcacccaggctggagtgcagtggtgcgatcacggctcacagcagcctcaacctcccagggtcaagtgatcctcccacctcagcctcccaagtagctggaactacaggcatgctaccatgcccagctgattgattgttttatgtttttgtaaagacgaggtcccactatgttgcccaggctggtcttgaactcctgggctccagcgatcttcccacctaggcctcccaaagcgctgggattacaggcatgtgccaccacgcccggcaacagtaccaactttctggcagtgtccttctgaagaaaacctaatgggagttgttacatctttctgtgcggcacatgcatggcatttgacacacaggctcctgagtcacgctggctgagttgaaattccaagtcttctctgtgactgcaggtgatttcttaccctctctatgcctcaatttcctcatctgtagatgggaatactatcagcagccacatcataaggctgatataatgattaaaatgataatctaggagacgctgctcagtacagcacagtgcctgccacgtagtgacatctaatagataatagcaattattattattatcattctgaaagttgcaaactcaaaccccaacagccatcttgtgggtaacacagacaagtaaagtgacctggtgggcccgtgtacacgaggcagccacatcccccctcactcaaatggttacctctgggaatgaagaccagaatttcgaatttcttaataggcactctaaatttgatttggattggaaatcattgattttggctactaattcaagttttgatttttaaaatttaccttttctttaagaaaggaggaagaggaccctatgctgtcattattccatctggagcccacacctgactcacaaagctctaggtttccttctggcttacgtatttcccatcgctgctttctagcacccaccttcattggagggctgtatctgcctgctcactccaataaacagtcagtttcctccaaatgttgctgttgtgcgttttttgtttgctttaattctaaaagaaagccaaacagcagtcagcctccaggccaaagaagaatgaataacctaacttctacccatttctaaaccacccagtctttcactgaacatccttccttaggagacgtttagcttaacatctctccctgctttctgtctttaactcaccttctaaacaagagaaaatcagacgtcacaatttgaaaactatccctcaatagggttacaagaaaaagcaggcaataagagcattttacatccacaacagaatcatctgcaatacttgatgacaagcaaacggggttctcagtgtctttcataacagctgccccttttgagctaggataaaagaaagtgcaaaagagagacaatgaataggcttttatttcaaagagaacatctgcaaagcatagtcctccattaaaaaataaacagaaaacagccactagtctggggaaaaaaataagatttcccattacatctctaattaataaagccccatttcaaaaggaaaaaagaagaagaaaaaaaagaataactttttcacatccccaaagaaaggatgcttaatgaggtaactgttgtattacttgatccatctagtctggttttaatactatccttaaataatgtatacattagctttccattaccaaaaacatttgtttattttatgaacgtgagtctggttgagagctgagactctgcaaaattatcatgccgtccttgggctcccggcttttattgcttctcccctcgctcattatgaaatgattagttgtctccgatgcccttttgaattgctgctaacgttgtactgcggttctgttaccctggttctgaataggagagtcttggttcagggttaagttaatgtagtcattactggcccatttggggacccattcatcatgctaatttcatgtccaacacttgggggaatagagtacaaatactcaacgtgaagcaaatgcacagtgaatccaaaagacgcacatgaaatgtccagaactcagtcacagaagacaggcatggggagctctggggccattactttccataactgtgggagcaatgcagacatcagagagggcctccaatggggaattcctttccaagggacccagagcacagttcctcctaacatctaactttaatcctttccacttgaacttcagaacaaaacagcacagctgtttaccagaggagcaaagactcttcaaactggttaagttgacattgaccaaaccttggccatctcagcacttccttgatcgtcattaaccaaccaagctgcaatcaggatttgaaatccagttagagtttgcttatgtgttttcattttgttaacccacttcttcttacttaaatgccactttacctgcatgttaaacgagaagagtgttgaagctgccgttttgattggctggttatatttctgtattttccataatatacatttaaagaaatatacagcgattaataatttctttaaatattcacccaagaagaagagagtgcatctgggatgttgtcagtgctatgattcctggtctaggatactcggatgtgttcagtttgtgagaattcatcaagttgtatatttagagtaatgtttgtatcatatggttttgttgggaaaaaagcaactaaaagaacgcaggcaatatttaagaagtgagccagacgtggtggctcacgcctgtaatcccagcagtttgggaggctgaggtgggaggatcacttgatcccaggagttccagaccagcctgggcaacatagcaaaaccccacctcttcaaaaaatacaaaaattagccgggcatggtggcacgcacctgtagtcccacctactcagggggctgaggtgggaggactgcttgagcctgcgaggtcaaggttgcagtgagctgagatcaaaccactgcattctagccggggtgacgtaaggagtccctgtctcaataaattaacaaataaatttaagaagtgaataaatgttgtacagatacgaatagtaactttttataaagagtttttacagaatatctgcccttgtagcacctccaaccactggtgcatcacgattggtgtctataccatattttggattcctggggctcgtttaggactactatggcaaaaggcatgatccaaaataaatccttacccctgaataagtaaaataaatccacccatccaaaacaaatgcttatccacagctctttcttttcgttcagctccctaatggtttccttcgctgcatttgtaacaatctgattttttgcaatgttcttgtttgtttttattgggaggtcatcctgcccccaaaccataaagagcatgagggcagggtcacatctgtctttccccctgctgtgcataaggcctggcacacagcagaccccaaccagtatctgatgaatgaatggatgagtaggtgggaaatttccagtggatttcactcattcattctctccctgtcccccacgggttacaagacgctgtgaggaaggaacgcagacaaccccgtctgaacactcccacattgtgctgcttgaagacatgagccccgtcttccattcacatggggctttctgagcttcaaagcactttctcatctgtttatcaaatttaatcctcacaacccagggagggaggcaggcttattagcatcatctgatgaagtgccaaaaagacacagagatgaaagtcacggtccgtccctgacagcgctgggaccaagccaaggtgctcaggaatgttctacttttccacctcccccttgtctctaaagactcccaacttcccaatgcgtgttattgggggacaaggtcacgggaaacacagagtgaggggcagatgactcaaaggaggctgtcactcacactccctgcagaggggaaacaggtttatcaaattgcggaatgcatgattctatttctgtcggggacatttgccttcaggatggcctcatgcttataagaatttgcatattctgggtctccaccaccagctaggcggggagggagactccatcatgccagggcaaggcacaggcagtgagaggcaaataagtgcagtgaataagccacatgggaatagggtaaccacagatgctcatttttatgtcttcatagtgaacacggaggtcttccaaatgggctgcaaactcaacagccaagaggggccagccaggtgccacaggtgacaggagagatcttagggggactcttagggacccagtgggtctgcagtatcaccattcctcagcttggctgtttaacaccaagcaagcaccgtggaccctgtattgccggatcttatgacttttaaaagaattccaaaaatctacgctgtctcacggcatatcctaatctttaaattccagggcctatttattctaacacaccgtgtggacaaaatcaaacccacccacgggccatggatttgaaagtcctcctggctctagcaaacatctcctacgatgtggctgcatcaggtggcagagcagagcactgaccatgacccagagctgtgcctcaccatcaagccctgccaggtaggtgccatcatggcccctgtgcttcagacaaggagactgagctccagagaggcaaagtgccataccaccgatgatgtcagaccactgtcttcttcctcaacatcacacgacctgcctcccaggccccacagcatctgcccatctgctcccctggatcatttccagggttgtttcatgagctacaagaagaagagcttgggccccatgagcagagcagcccaggcctcatggacagttctgggatggcagagacctcagggctcccagggctctgaatcatactacttactccttgccctgaccttcccagaggacacctcccttgtgtgttcaagaggtcaccatgggaaagggtataggcaatgaaccaggctaggatgtgagagtgatctccctagagatcggccacttatcagcacgggctctaactcttgcctgctagactggtcctcctggagggcaggaggcacattggtcctgttcaccaaggtggttccagtgctggacacagggactggtaccttctaactgcaggagtggaggatgggtagataggtggatgaatggatcgatgggtaaatggatggacagatggatggatgaatggacagaggatggatgaatggacggatagatggatggatggatgcttagacaaatagatgaatggactgatggatggatggatggatggatgggtggacaaatgcatgcataaatagatggaggcagggggagaatgaggggctagagtcaacggacttactgactctgaactgggtagactgagaacacagcctttggagacaccacccaacttcaatttctagtttggacacttcacatctgcttaattttcatccaacttattgccttagttttcattatttcaatcagtaaaacagaaatgaaaataatagctcttaacttgccagatgttataagaattcaataaaagcatgtctttttagtccttccacagtgtttggtgcattcgataaatgcacctcatcatcaccatagttgcaatgtttgtgcctcctgggtagggaacatttgcatcaacctctctgccccacaaactcatcttaaactgaaaccacacatcttgtggccaaaaattatggcaaagcgtgccctgggaggagaaacaaatgcctcttaccacattacctcattagcatccactgacacattagcctggattagatgtccagataagcagtagtcacctggctgggacaaactaggcctgggacaggacaaatccattcattgcccctaggtggccctgaaagatgagacaccctcgtccacacacacaaagcttgagaatgggtcccaccccttcctcatctggcagggtgtctgggtttgcagttcctgacactaataatgccagtgtccaggttcagggctaaggtgacaccccaccccacacccatcttctttgtgatgcctctggcttccaatcgggaagggggcaaccgaacccagagagcacatgggcaccatctgatgagcatctgcgggcaaacgggtagtttctgttgcaggcggaaggaagtgtccgcaagatgatccgcactgcatgtttattgaggtaactctccagtgtgctgcagacccaggctctcaggtacaagtggcgggctcctcagtgggccaaccacagagcggtctgaaggaatggagcagcaggaagtctgttgtggttgaaagaaaggccattgtccccggccaaagaaccctgaacaatatcctcttgccccctcctccgcttctcccttggttagagagagctgaattcaagactcctctctctagccaatttcaacttccattcttgactgttgaaaatataatagtacacagcttgaaggattaaatgagttcatgcacaaagagggtttagaacagtgcctggcaaacagaatagagaacgcagaaataaacccacactttaatatcaactcatttttgacaaaggctggggaaaggaaagtcttcgataagtagtgctggaaaaacgggatagccattacctatggataaacttaagaatgaaactaggccccatcactcaccatacacaaaaaccaaatcaaaatagattaaagacttaaatctaagacccgagactatgagacgactagagaaaaaaacattggggagacacttcaggacgctgagcaagaattttttttgggtaagaccacaaaagcacaggcaacaaaagcaaaaatagacaaacgggatcacatcaagctacaaagcttctgcacggcaaacaatcaacaaattaaataatctacaaaatggaagaaaatatttgcaaactacccatctgacaagggattaataaccaaaatatataaagaactcaaacaactcaacagcaaaaaaacaagtagtccaattttttaaacaggcaaaagagctgaacagatatttctcaaaagaagacatacgaatggccaatggatatataaaaaaatgcacagcatcactaatcaccagggaactgtgagtcaaaagcacagtgagatatcatctcaccccacctgaaagggcttttatcaagaagacaaaaaataacagacgctggtgaggatgtgagaaaatggaacactcatacactgttggtgggaatgtaaattagtacagccactatggagaagagtatgaaggttcttcacaagctaaaaacagaactaccatatgatctggcaatcccactactgtgtctacacaggaaaggattaattatccaaaggaaaggaaatcaataaatccaagagctatctgcactcccatgcttactgcaacattcttcacaatagccaagatatgaaatcaagttaagtgcccatcggtggatgaatggataaagaaaatgtggtaaacacacacagtggaatattagccagctgttaaaaagtgaaatcctgtcatttgcagcaacatgaataaaccggaggccatcatactaactgaaataagccaggcacttagagacaaatatcacatgttctcactcctatgtaggagctaaaaaaagtagatgacaagaagatagagagtagataggtgattaggggagtagggaggaagatgttgattggaaggataaaaatccagttagatagaaggaataagctctagtgtttggtagtccagtagggtgattatcattaacaataatctattgtatatttcaaaatagctagaagacccgggcacagtggctcacatctataatcccagcactttgggaggccaaggcaggcagatcacctgaggccaggagtttaagaccagcctggccaacacggcaaaacctcatctctactaaaaatacaaacagaattagccaggtgtggtggcgggtgcctgtaatcccagctaatcaggaggctgaggcaggagaattgcttgaacctgagaggcggaggtagcagtgagtcaagattgtgccactgcactccaggccgggcaacagagcaaaactgtctcaaaaaaaaaaaaaaaaaaaggagctagaagagaagaatttcagtgtctctgacaaaaaagtaaagataaatgttggcggtaatgaatatcccaattactttaagttaatcattacacattatatgaacctatcaaaatatcacatgtaccccaaaatatgtcaaactattatatatccatttttaaaaccacctaacacatcataactgccatgcagtcattattattattattatcattattactacccttgtatttgcatcatgagttaggggtctgattcaatataaattgcatgtctgcttcttttctagggttggtaactttttaggaatctgcaacaagaagtgagaaaagtagaataaagatttttggggctgggcaaagtggctcaggcctgtagtcccagcattttgggaggccgaggcgggcggatcacgaggccaggagttcgagagcagcctggccaacatggtgaaaccctgtctctactaaaatacaaaaattagccaggcgtggtggtgcacgcctgtaatcccagctactcaggaggctgaggcacaagaattgcttgaacctaggaggcggaggttgcagtgagccgagatcacgccactgccctccagcctgggtgacagagcaagatgctgtctcaaaaaaaaaaaaaaaaaaaaaaaaaaaagatttttgggaatgcatggttgcatttagggtttttcaacaaaccatgcaaaaggaacgcaactcggaaaggtggcatctttggaaaggggcaggcctgggtttggatctcagttctgctactccccagctctgtgaacttcatgagcaagcagcttcacttctttgagcttcagtttcctcctggggacagcaaaagtcttatcccacaaagttgggagaaatcagtaagacagtaaggtaacatttacaaatccctccattattcctgccacataacaagccatcataagaccagcgatttctagttgggtgtccttagttttaactttttatcagttgtgtaataccgtcttccttcctggaaattttttgtgtttttttttggggggggggggggtgagcatttaataacctaacgtatgcaaaatacctaaatgacacctgacatacagcaggcactcaataaatgtcagtactccttcctctaccacattccgtcctgctcacacagaaacagctatattcattctactgccttggatttactcgcaccctacactgtacgggaaaatgaataactgcaagaaattccttattttcaaacataccaagaatttccttttaagaacagctcatttttgaacactgattaaggaacaggcccacatgagttcacatatattgctacatttcatcctcatacagccctatgaggtagctcagattcacagaggaccgaaattacagtgacttgcccaagattaggggcatgagaaagggccgagccaggaggtgaacccaggtatgtcaggcctgagggtactcaacagaggcctctttcattggtgccggggcctcgcacatacttgttgggacgttttctcctgttcccacaccccttccttagaatgcaggttttgttaagatcgagtttgttttttagttattttttattttccccaaggcattttctctttgtttctggtagatggggatctgggtccgcagaaatggggaaatgcaaaggaaaaggaaagagagagatcataagtggcagctcttaaggtagcactggtcaaaagatagagactctcaacctcacctgtgcagtccaacaggtgtgtgtgttaagttcttctgcactgaaacactcatatagatggatttatgaccttatggatcataaacagctctggagcggggtgtggggggcagactcttatgtcagagatatgcctaaggatatctttgctttctgaggatacacacacacatacacaatgacgcgatgatgtcaaatctctgctttaactcaagccaccaaatttcctcttctattaaaaccatgaatcaaacttgaacagtcaccagtaaataagaacttacgccatggctggcttcctaggtgaaaaatagcaagcctttgaccacccacccttctggaagatttttaaaaaatgaattgataaactgaagagaacgtctaaagtatgaaaagaccggaaggaaagtgaatacatagatatattagaattcatattacaaacatatctatacctacgtatattatttctacttttatttatctattttaacactttccatgataaacagatggcaacatttgcagtaagataaatattattcaatgatgcatatttctgtatacaaagtgtaatgcgtcgctcaaacaaaacaaaactccattgaaagtgtgaaaaaaaaaacgaaccatcaataacataccctgttttctgtggtctcagaacatctggataggaagaaaagctatacctccaaggctgttagaagcagaggtgatctaaagccagtgaaccgatctttcaaagtcactgctgatgtctaaaagagtcctgagttatctgagtaatgtgaagcatgaggaatttctgccgaaaaatcaacatttcaaaggcgtcggataatacagaaaccccattctactttgtgtgcttatgtagggcggcaggcggggggtgggaagggtaataaaaaattagatttcttaaatgaaacttactgagtaacagtttatctaagaacacgagcaataaatgtggggacttcaagaagagtcactaagggaaagaaaataaacattcattacattaacacacgcagctctctttcattttctccaaaatctattcagaacctgtaggctgatccttgtgacagttctcccaatatttttcctccctttataagggagtccatctgtttcttaaattctgagatgacagtaaaatccacagcttactggagacccagtgaaggaatcagtgtcagccacaaaacagctgcaatccacccaataattctaatatttaagagctttaaaagaggctgagaggaaaaggagagcttgcaaatcttttatggacatgccctctgactctgtctacttgagaaacggggtgtttcctcttggcttcttaagtgcaccaaaaatacaatcagggccttccaccgaagcgcagctccccaaacataaaaaggacaaatgctctgaggctgtgggcatcaggaaggaggaagatctggcttaggaaatgccctatacacaatgcctgcctgacactctctgcaacacacccaccagcaacccaggacacaggttccctctacatgcaagagccaaggctgtccacccaccccatccccacctgcaacagagcactgagctaaagcatcttcttctaagcatgtgtctaaccacctctctacaagagccatctggaaaatcacggggatttgtttctttaaatgtcccactcctgaatctccctccaaagcatcatcctggcagcctccgcagggtctggaaacaaactgcacatttcaacggcctctattgcttgcgaaaaggtctggtcctctccttgcctgcaacccaagctccagctataccagactttgggaacagcctgcccccttctggtctcctggagctccatggaagggcaggaactgggtgggcacagtcagagtaggacagaccccgggctccagccagcctgtctgtactgtgatttcaggatttagcaggtcatggagtaggtgtggggggagaggaaagaaaggagacaagcaaatgaaataaaatacaaagccccaagagacaacagtcaacagcatggtagacagccaccaagaagagaagagaaccaaaagaaaaaaaaaatacataaatgtccatcttggaaggtaaagaaattgagacattaggacatgcagatttggggagagtaactgaacttgcagttggaagcagagtttcagaaaagcaaagcacctccgctgctggaactgcaattccaaaaggaagtaaaaaggaaaatagtgtgttcccacctacctccccaaccgcagatctctcagaggctgagctgggtgtgagagagtaaaacactgagccgagcacacagagaggggctgggggtggatgctcacaatgccggggacctatgaagaaatcagctagccctgcctccttccttctcttcatttgtttcaacaggtgctacatgcatcctaaaggtacctcctgaacccactctgacccccagatgcaaatgatacagtaagccccaggcttcccccaccatgtctcccctacacgttcttacactggaccagcaggacacgacccacaaccctcccaccccacctcctgggctctggatgcacaaagaacttctaattgcatttctgcgggaacccatcactatcaactccaagagttcaaaggcagcgtttcagagtacccctctctgtaaagaagagatcgcaggacactaggaatgttctggttctccgtcaggcagctcacgccactattctccccgcaaatgagggaaagacttctccctgctacccacacagcaacgtgaaatgccatcacatcacgtcttgggactggctcagttctcaggcatgaagagctgcactccggcagaaagggtcgcacagactccgaagaagtttagcagctcagaaagcatcacgctgtgtactaaggcagtcttcagtgaggacttccaaagtgacaaatgatagaaatatgcattcagtcttcaggatcctgaaaccatccccctggtgtctaatatcctttaacggctaggcaaatccttgcagacaagtagtgtgatgaagaaacagacagacacacaacacattggctatgccctaaggcagaactcacgcccctggagaactgagaccttggctctgaaatggggactccggcctcctgccccatgtgctcctgctcctagctcagtaggctgggcaaggcagcccagagaaggtgggaaaggtatccctggagaagttagggacagggtaggaagacaagtcagttccccacccagccacccagatggccccagatctgcggaaaaaacagtttcagagccctgactgttcacacccacgaagggcaaagtaatcccataggagtggaagccctgacggtgtggtcggacacacagctggtgacctgaaccggccgcaacaagacagaaagacagagacaaccagctaggagaaggagccatgccctgaaactggagatggggaggagataaagtcacagagggcatgggagacggcaaggttagagacagagaaggtgaagacggaaggctcaaacatccagagaagagaaacagaagacccaaagtaagaccagacaccccggactgagtattgattcaggggcatggtcggggacttgggacgcccagctcagccctcatcgcaggccaggacgaacagagggctcaactgtctgcacccagctcggcaaaaaccagagagatgctgctgcgacaaccgcccaggaacagcggctgaggatccggggagatccactcactcaggcagggagcgagtcaccaagacctacacgcacggagcaagtcacctggggtccccagcaagagtgatggggaacaggaacccagccaggctccggtaacccccaaagcgcccccgctggagaaaacttcccccagaccccaaggggtccgtgctcagactctgaaaggggcagcccacgacccctgagccttggcagggaccccacccggcttcccggggcaagaggcgatgtggagtcggtaggcttgcagagtcccagtctgatgaccgagttcaagggctaggggggcgtggggtcgggctgccttcctccctccctcgccgcggggcgcgagccgaaagggcatcttaccagagcccgggcgggcagtgccccccggctggccggctgctgtccccgcggttctccggggccgcctccccgcgcccgcgcctggggcccccgtcctcctcctcctccgccgccgcctcctcctcctcctcgggctgcagccggctcggcgggcaggtcccggcgctcccggcgcggggccggggccgggggcggctgctccccgccgccgaccgctgcgcccccgcggcgctccccggccccggagtcgaggctgctgaaattccacacgaccagcgtctgcagcagcagcaccgtgagcgccgcgagcagcgccgagtgcgagcgccgggccagcctccgggcgcacggcgccgccaccatcttcggagcgcggccggcgagcgaggcgcggggaccccggcacgctccgggccgcccccgcgctccccgcagctcccgcggccgc
